US012465652B2

(12) United States Patent
Walker et al.

(10) Patent No.: US 12,465,652 B2
(45) Date of Patent: Nov. 11, 2025

(54) METHOD OF TREATING OR AMELIORATING METABOLIC DISORDERS USING ANTAGONISTIC BINDING PROTEINS FOR GASTRIC INHIBITORY PEPTIDE RECEPTOR (GIPR)/GLP-1 RECEPTOR AGONIST FUSION PROTEINS

(71) Applicant: AMGEN INC., Thousand Oaks, CA (US)

(72) Inventors: Kenneth W. Walker, Newbury Park, CA (US); Jerry Ryan Holder, Simi Valley, CA (US); David J. Lloyd, Thousand Oaks, CA (US); Shu-Chen Lu, Thousand Oaks, CA (US); Murielle M. Veniant-Ellison, Thousand Oaks, CA (US); Shanaka Stanislaus, Thousand Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 16/623,756

(22) PCT Filed: Jun. 20, 2018

(86) PCT No.: PCT/US2018/038634

§ 371 (c)(1),
(2) Date: Dec. 17, 2019

(87) PCT Pub. No.: WO2018/237095

PCT Pub. Date: Dec. 27, 2018

(65) Prior Publication Data

US 2020/0384119 A1 Dec. 10, 2020

Related U.S. Application Data

(60) Provisional application No. 62/523,216, filed on Jun. 21, 2017.

(51) Int. Cl.

| | |
|---|---|
| ***A61K 47/65*** | (2017.01) |
| ***C07K 14/72*** | (2006.01) |
| ***C07K 16/26*** | (2006.01) |

(52) U.S. Cl.

CPC .............. *A61K 47/65* (2017.08); *C07K 14/72* (2013.01); *C07K 16/26* (2013.01); *C07K 2317/21* (2013.01); *C07K 2317/31* (2013.01); *C07K 2317/565* (2013.01); *C07K 2317/94* (2013.01); *C07K 2319/30* (2013.01)

(58) Field of Classification Search

None

See application file for complete search history.

(56) References Cited

U.S. PATENT DOCUMENTS

| | | | |
|---|---|---|---|
| 3,773,919 | A | 11/1973 | Boswell et al. |
| 4,399,216 | A | 8/1983 | Axel et al. |
| 4,619,794 | A | 10/1986 | Hauser |
| 4,740,461 | A | 4/1988 | Kaufman |
| 4,816,567 | A | 3/1989 | Cabilly et al. |
| 4,912,040 | A | 3/1990 | Kaufman et al. |
| 4,946,778 | A | 8/1990 | Ladner et al. |
| 4,959,455 | A | 9/1990 | Clark et al. |
| 4,965,195 | A | 10/1990 | Namen et al. |
| 4,968,607 | A | 11/1990 | Dower et al. |
| 5,011,912 | A | 4/1991 | Hopp et al. |
| 5,260,203 | A | 11/1993 | Ladner et al. |
| 5,292,658 | A | 3/1994 | Cormier et al. |
| 5,418,155 | A | 5/1995 | Cormier et al. |
| 5,470,582 | A | 11/1995 | Supersaxo et al. |
| 5,530,101 | A | 6/1996 | Queen et al. |
| 5,545,618 | A | 8/1996 | Buckley et al. |
| 5,545,806 | A | 8/1996 | Lonberg et al. |
| 5,545,807 | A | 8/1996 | Surami et al. |
| 5,569,825 | A | 10/1996 | Lonberg et al. |
| 5,585,089 | A | 12/1996 | Queen et al. |
| 5,625,126 | A | 4/1997 | Lonberg et al. |
| 5,633,425 | A | 5/1997 | Lonberg et al. |
| 5,661,016 | A | 8/1997 | Lonberg et al. |
| 5,683,888 | A | 11/1997 | Campbell |
| 5,693,761 | A | 12/1997 | Queen et al. |

(Continued)

FOREIGN PATENT DOCUMENTS

| | | | |
|---|---|---|---|
| AU | 31399/84 | A | 1/1984 |
| CN | 101044162 | B | 10/2010 |

(Continued)

OTHER PUBLICATIONS

Finan et al. (Molecular and Cellular Endocrinology 418 (2015) 42-54) (Year: 2015).*

(Continued)

*Primary Examiner* — Brian Gangle
*Assistant Examiner* — Andrea K McCollum
(74) *Attorney, Agent, or Firm* — Carissa R. Childs

(57) ABSTRACT

Method of treating metabolic diseases and disorders using a composition comprising a GLP-V/GIPR antigen binding protein fusion protein are provided. In various embodiments the metabolic disease or disorder is type 2 diabetes, obesity, dyslipidemia, elevated glucose levels, elevated insulin levels and diabetic nephropathy. In certain embodiments the composition comprises the C-terminus of a GLP-1 analog fused to the N-terminus of the light chain variable or heavy chain variable region of an antibody or functional fragment thereof that binds GIPR, optionally with a linker in between.

20 Claims, 48 Drawing Sheets

Specification includes a Sequence Listing.

(56) References Cited

U.S. PATENT DOCUMENTS

| | | | |
|---|---|---|---|
| 5,693,762 | A | 12/1997 | Queen et al. |
| 5,741,668 | A | 4/1998 | Ward et al. |
| 5,770,429 | A | 6/1998 | Lonberg et al. |
| 5,777,079 | A | 7/1998 | Tsien et al. |
| 5,789,650 | A | 8/1998 | Lonberg et al. |
| 5,804,387 | A | 9/1998 | Cormack et al. |
| 5,814,318 | A | 9/1998 | Lonberg et al. |
| 5,874,299 | A | 2/1999 | Lonberg et al. |
| 5,874,304 | A | 2/1999 | Zolotukhin et al. |
| 5,876,995 | A | 3/1999 | Bryan |
| 5,877,397 | A | 3/1999 | Lonberg et al. |
| 5,925,558 | A | 7/1999 | Tsien et al. |
| 6,114,598 | A | 9/2000 | Kucherlapati et al. |
| 6,162,963 | A | 12/2000 | Kucherlapati et al. |
| 6,180,370 | B1 | 1/2001 | Queen et al. |
| 6,255,458 | B1 | 7/2001 | Lonberg et al. |
| 6,270,964 | B1 | 8/2001 | Michnick et al. |
| 6,300,129 | B1 | 10/2001 | Lonberg et al. |
| 6,506,724 | B1 | 1/2003 | Hiles et al. |
| 6,565,841 | B1 | 5/2003 | Niven et al. |
| 6,673,986 | B1 | 1/2004 | Kucherlapati et al. |
| 6,703,359 | B1 | 3/2004 | Young et al. |
| 6,713,610 | B1 | 3/2004 | Kucherlapati et al. |
| 6,753,165 | B1 | 6/2004 | Cox et al. |
| 6,833,268 | B1 | 12/2004 | Green et al. |
| 6,858,576 | B1 | 2/2005 | Young et al. |
| 6,872,700 | B1 | 3/2005 | Young et al. |
| 6,902,744 | B1 | 6/2005 | Emmot |
| 6,956,026 | B2 | 10/2005 | Beeley et al. |
| 7,045,337 | B2 | 5/2006 | Schultz et al. |
| 7,049,426 | B2 | 5/2006 | Green et al. |
| 7,064,244 | B2 | 6/2006 | Jakobovits et al. |
| 7,081,473 | B2 | 7/2006 | Tsubamoto et al. |
| 7,091,183 | B1 | 8/2006 | Wolfe et al. |
| 7,157,555 | B1 | 1/2007 | Beeley et al. |
| 7,220,721 | B1 | 5/2007 | Beeley et al. |
| 7,223,725 | B1 | 5/2007 | Beeley et al. |
| 7,368,427 | B1 | 5/2008 | Dong et al. |
| 7,456,254 | B2 | 11/2008 | Wright et al. |
| 7,521,423 | B2 | 4/2009 | Young et al. |
| 7,572,451 | B2 | 8/2009 | Bachmann et al. |
| 7,666,838 | B2 | 2/2010 | O'Harte et al. |
| 7,875,587 | B2 | 1/2011 | Gault et al. |
| 7,959,924 | B2 | 6/2011 | Bachmann et al. |
| 8,263,545 | B2 | 9/2012 | Levy et al. |
| 8,999,940 | B2 | 4/2015 | Dong |
| 10,294,303 | B2 | 5/2019 | Yie et al. |
| 10,538,569 | B2 | 1/2020 | Sung et al. |
| 10,905,772 | B2 | 2/2021 | Cheng et al. |
| 11,046,774 | B2 | 6/2021 | Yie et al. |
| 2003/0036504 | A1 | 2/2003 | Kolterman et al. |
| 2003/0157107 | A1 | 8/2003 | Miyawaki et al. |
| 2004/0029805 | A1 | 2/2004 | Wolfe et al. |
| 2004/0106547 | A1 | 6/2004 | Larsen et al. |
| 2005/0159379 | A1 | 7/2005 | McSwiggen et al. |
| 2006/0068910 | A1 | 3/2006 | Schmidt et al. |
| 2006/0094652 | A1 | 5/2006 | Levy et al. |
| 2006/0125763 | A1 | 6/2006 | Akai et al. |
| 2006/0275288 | A1 | 12/2006 | Grihalde et al. |
| 2008/0125371 | A1 | 5/2008 | Wolfe et al. |
| 2008/0182795 | A1 | 7/2008 | Wolfe et al. |
| 2008/0312098 | A1 | 12/2008 | Kozian et al. |
| 2008/0312157 | A1 | 12/2008 | Levy et al. |
| 2009/0036364 | A1 | 2/2009 | Levy et al. |
| 2009/0042922 | A1 | 2/2009 | Romo et al. |
| 2009/0074769 | A1 | 3/2009 | Glaesner et al. |
| 2009/0186817 | A1 | 7/2009 | Ghosh et al. |
| 2009/0209469 | A1 | 8/2009 | Kim et al. |
| 2010/0143392 | A1 | 6/2010 | Bachmann et al. |
| 2011/0136737 | A1 | 6/2011 | Levy et al. |
| 2012/0101037 | A1 | 4/2012 | Danho et al. |
| 2012/0157379 | A1 | 6/2012 | Hsu |
| 2012/0238493 | A1 | 9/2012 | DiMarchi et al. |
| 2012/0322725 | A1 | 12/2012 | DiMarchi et al. |
| 2013/0344524 | A1 | 12/2013 | Miyachi et al. |
| 2016/0194371 | A1 | 7/2016 | Boscheinen et al. |
| 2016/0297883 | A1 | 10/2016 | Gallo et al. |
| 2017/0114115 | A1 | 4/2017 | Alsina-Fernandez et al. |
| 2017/0275370 | A1 | 9/2017 | Yie et al. |
| 2018/0311372 | A1 | 11/2018 | Cheng et al. |
| 2019/0276546 | A1 | 9/2019 | Yie et al. |
| 2020/0384119 | A1 | 12/2020 | Walker et al. |
| 2021/0087286 | A1 | 3/2021 | Bates et al. |
| 2021/0154318 | A1 | 5/2021 | Cheng et al. |

FOREIGN PATENT DOCUMENTS

| | | | |
|---|---|---|---|
| EP | 0036676 | A1 | 9/1981 |
| EP | 0058481 | A1 | 8/1982 |
| EP | 0088046 | A2 | 9/1983 |
| EP | 0133988 | A2 | 3/1985 |
| EP | 0143949 | A1 | 6/1985 |
| EP | 0367566 | A1 | 5/1990 |
| EP | 0367566 | B1 | 5/1990 |
| EP | 0460846 | A1 | 12/1991 |
| EP | 0460846 | B1 | 12/1991 |
| EP | 0546073 | B1 | 9/1997 |
| EP | 1283058 | A1 | 2/2003 |
| JP | 2010-514835 | A | 5/2010 |
| JP | 2011/511753 | A | 4/2011 |
| KR | 10-2009-0096498 | A | 9/2009 |
| WO | 88/01649 | A1 | 3/1988 |
| WO | 90/04036 | A1 | 4/1990 |
| WO | 91/10741 | A1 | 7/1991 |
| WO | 92/03918 | A1 | 3/1992 |
| WO | 92/15673 | A1 | 9/1992 |
| WO | 92/22646 | A1 | 12/1992 |
| WO | 93/01227 | A1 | 1/1993 |
| WO | 93/15722 | A1 | 8/1993 |
| WO | 94/02602 | A1 | 2/1994 |
| WO | 94/20069 | A1 | 9/1994 |
| WO | 95/07463 | A1 | 3/1995 |
| WO | 96/33735 | A1 | 10/1996 |
| WO | 98/05351 | A1 | 2/1998 |
| WO | 98/14605 | A1 | 4/1998 |
| WO | 98/24464 | A1 | 6/1998 |
| WO | 98/24893 | A2 | 6/1998 |
| WO | 98/26277 | A2 | 6/1998 |
| WO | 99/07404 | A1 | 2/1999 |
| WO | 99/10494 | A2 | 3/1999 |
| WO | 99/25727 | A2 | 5/1999 |
| WO | 99/25728 | A1 | 5/1999 |
| WO | 99/40788 | A1 | 8/1999 |
| WO | 99/49019 | A2 | 9/1999 |
| WO | 00/20592 | A1 | 4/2000 |
| WO | 2000037098 | A1 | 6/2000 |
| WO | 00/41546 | A2 | 7/2000 |
| WO | 00/41548 | A2 | 7/2000 |
| WO | 00/73331 | A2 | 12/2000 |
| WO | 01/51078 | A1 | 7/2001 |
| WO | 01/055213 | A2 | 8/2001 |
| WO | 01/87341 | A1 | 11/2001 |
| WO | 2003/55914 | A2 | 7/2003 |
| WO | 03/072195 | A2 | 9/2003 |
| WO | 03/097031 | A1 | 11/2003 |
| WO | 03/099314 | A1 | 12/2003 |
| WO | 2004083211 | A1 | 9/2004 |
| WO | 2005000892 | A2 | 1/2005 |
| WO | 2005021022 | A2 | 3/2005 |
| WO | 2005102293 | A1 | 11/2005 |
| WO | 2006045796 | A2 | 5/2006 |
| WO | 2006068910 | A1 | 6/2006 |
| WO | 2006086769 | A2 | 8/2006 |
| WO | 2006086769 | A3 | 8/2006 |
| WO | 2006125763 | A1 | 11/2006 |
| WO | 2007028633 | A2 | 3/2007 |
| WO | 2008021560 | A2 | 2/2008 |
| WO | 2008021560 | A3 | 2/2008 |
| WO | 2008081418 | A1 | 7/2008 |
| WO | 2008101017 | A2 | 8/2008 |
| WO | 2009042922 | A2 | 4/2009 |
| WO | 2009068910 | A1 | 6/2009 |
| WO | 2009042922 | A3 | 11/2009 |
| WO | 2010012495 | A1 | 2/2010 |

(56) References Cited

FOREIGN PATENT DOCUMENTS

| | | | | |
|---|---|---|---|---|
| WO | 2010016935 A2 | | 2/2010 | |
| WO | 2010016936 A1 | | 2/2010 | |
| WO | 2010016938 A2 | | 2/2010 | |
| WO | 2010016940 A2 | | 2/2010 | |
| WO | 2010016944 A2 | | 2/2010 | |
| WO | 2011014680 A2 | | 2/2011 | |
| WO | 2011094337 A1 | | 8/2011 | |
| WO | 2012055770 A1 | | 5/2012 | |
| WO | 2012088116 A2 | | 6/2012 | |
| WO | 2012167744 A1 | | 12/2012 | |
| WO | 2015022420 A1 | | 2/2015 | |
| WO | 2015086853 A1 | | 6/2015 | |
| WO | 2015095354 A2 | | 6/2015 | |
| WO | 2015185640 A1 | | 12/2015 | |
| WO | 2016/108654 A1 | | 7/2016 | |
| WO | 2017/112824 | | 12/2016 | |
| WO | 2016209707 A1 | | 12/2016 | |
| WO | 2017074714 A1 | | 5/2017 | |
| WO | WO-2017112824 A2 | * | 6/2017 | ......... A61K 38/1703 |
| WO | 2018/136440 A1 | | 7/2018 | |
| WO | 2018237095 A1 | | 12/2018 | |
| WO | 2018237097 A1 | | 12/2018 | |

OTHER PUBLICATIONS

Skolnick et al (Trends Biotechnol. Jan. 2000;18(1):34-9) (Year: 2000).*

Burgess et al. (J. Cell Biol. 111:2129-2138, 1990) (Year: 1990).*

Miosge (Proc Natl Acad Sci U S A. Sep. 15, 2015;112(37):E5189-98) (Year: 2015).*

Bork (Genome Research, 2000,10:398-400) (Year: 2000).*

Vajdos et al. (J Mol Biol. Jul. 5, 2002;320(2):415-28) (Year: 2002).*

Brown et al. (J Immunol. May 1996;156(9):3285-91) (Year: 1996).*

Almind, K. et al., "Discovery of amino acid variants in the human glucose-dependent insulinotropic polypeptide (GIP) receptor: the impact on the pancreatic beta cell responses and functional expression studies in Chinese hamster fibroblast cells," Diabetologia, 41:1194-1198 (1998).

Al-Sabah, Suleiman, "Molecular Pharmacology of the Incretin Receptors," Medical Principles and Practice, 25(1):15-21 (2016).

Althage, M. C. et al., "Targeted Ablation of Glucose-dependent Insulinotropic Polypeptide-producing Cells in Transgenic Mice Reduces Obesity and Insulin Resistance Induced by a High Fat Diet," The Journal of Biological Chemistry, 283(26) :18365-18376 (2008).

American Diabetes Association, Standards of Medical Care in Diabetes—2010, American Diabetes Association, Diabetes Care, 33(1):S11-S61 (2010).

Asmar, M. et al., "Glucose-Dependent Insulinotropic Polypeptide May Enhance Fatty Acid Re-esterification in Subcutaneous Abdominal Adipose Tissue in Lean Humans," Diabetes, 59:2160-2163 (2010).

Ausubel, F. M. et al., eds., "Hybridization with Radioactive Probes, Using DNA Fragments as Probes," Current Protocols in Molecular Biology, John Wiley & Sons, Inc., NY, Section II, Supplements Unit 6.3, pp. 6.3.1-6.3.6 (1989).

Ausubel, F. M. et al., eds., Brown, Terry, Contributor, "Hybridization Analysis of DNA Blots" Current Protocols in Molecular Biology, John Wiley and Sons, Inc., Chapter 2, Section IV, Supplements 21, 35, 29, 26, and 42, Unit 2.10 (2.10.1-2.10.16) (1993), Copyright (2000).

Ausubel, F. M. et al., eds., Duby, Allan, Jacobs, Kenneth A., Celeste, Anthony, Contributors, "Hybridization With Radioactive Probes, Using Synthetic Oligonucleotides as Probes," Current Protocols in Molecular Biology, John Wiley and Sons, Inc., Chapter 6, Section II, Supplements 2, 13, and 9, Unit 6.4 (6.4.1-6.4.9) (1993), Copyright (2003).

Ausubel, F. M. et al., eds., Short Protocols in Molecular Biology, 2nd Edition, A Compendium of Methods from Current Protocols In Molecular Biology, Greene Publishing Associates and John Wiley and Sons, New York Chichester, Brisbane, Toronto (1992) (Table of Contents Only).

Ausubel, F. M. et al., eds., Strauss, William M., Contributor, "Hybridization With Radioactive Probes, Using DNA Fragments as Probes," Current Protocols in Molecular Biology, John Wiley and Sons, Inc., Chapter 6, Section II, Supplements 24, 13, and 2, Unit 6.3 (6.3.1-6.3.6) (1993), Copyright (2003).

Baggio, L. L. et al., "Chronic exposure to GIP-1R agonists promotes homologous GLP-1 receptor desensitization in vitro but does not attenuate GLP-1R-dependent glucose homeostasis in vivo," Diabetes, 53(3):S205-S214 (2004).

Beck, B. et al., "Direct metabolic effects of gastric inhibitory polypeptide (GIP): dissociation at physiological levels of effects on insulin-stimulated fatty acid and glucose incorporation in rat adipose tissue," Diabetologia, 29:68 (1986).

Beck, B. et al., "Hypersensitivity of Adipose Tissue to Gastric Inhibitory Polypeptide Action in the Obese Zucker Rat," Cellular and Molecular Biology, 33(5):555-562 (1987).

Behrens, C. R. et al., "Methods for Site-Specific Drug Conjugation to Antibodies," mAbs, 6(1):46-53 (2014) (Downloaded by EPO Aug. 3, 2016).

Berndt, S. I. et al., "Genome-wide meta-analysis identifies 11 new loci for anthropometric traits and provides insights into genetic architecture," Nature Genetics, 45(5):501-512 (2013).

Bhatnagar, P. K. et al., "Structure-Activity Relationships of Novel Hematoregulatory Peptides," J. Med. Chem., 39:3814-3819 (1996).

Bianchi, A. A. and McGrew, J. T., "High-Level Expression of Full-Length Antibodies Using Trans-Complementing Expression Vectors," Biotech Biotechnol. Bioeng., 84:439-444 (2003).

Bong, et al., "Chemoselective Pd(0)-catelyzed peptide coupling in water," Organic Letters, 3(16):2509-2511 (2001).

Bootcov, M. R. et al., "MIC-1, a novel macrophage inhibitory cytokind, is a divergent member of the TGF-β superfamily," Proc. Natl. Acad. Sci. USA, 94:11514-11519 (1997).

Bostrom, J., et al., "Improving antibody binding affinity and specificity for therapeutic development," Methods Mol., Biol., 525:353-376 (2009).

Bowie, J. U. et al., "A Method to Identify Protein Sequences That Fold into a Known Three-Dimensional Structure," Science, 253:164-170 (1991).

Boylan, M. O. et al., "Gastric inhibitory polypeptide immunoneutralization attenuates development of obesity in mice," Am J Physiol Endocrinol Metab, 309 :E1008-E1018 (2015).

Branden, C. and Tooze, J., eds., Introduction to Protein Structure, Garland Publishing, Inc. New York and London (1991) (Table of Contents Only).

Brenner, S. E. et al., "Population statistics of protein structures: lessons from structural classifications," Curr. Op. Struct. Biol., 7:369-376 (1997).

Brons, C. et al., "Impact of short-term high-fat feeding on glucose and insulin metabolism in young healthy men," The Journal of Physiology, 587:2387-2397 (2009).

Bruggermann, M. et al., "Design Mice: The Production of Human Antibody Repertoires in Transgenic Animals," Year in Immunol., 7:33-40 (1993).

Campbell, J. E. et al., "TCF1 links GIPR signaling to the control of beta cell function and survival," Nature Medicine, 22(1):84-90 (2016).

Carrillo, H. et al., "The Multiple Sequence Alignment Problem in Biology," Siam J. Applied Math, Society for Industrial and Applied Mathematics, 48(5):1073-1082 (1988).

Chalfie, M. et al., "Green Fluorescent Protein as a Marker for Gene Expression," Science, 263:802-805 (1994).

Chamow, S. M. and Ashkenazi, A., "Immunoadhesins: principles and applications," TIBTECH 14: 52-60 (1996).

Chen, J. et al., "Immunoglobulin gene rearrangement in B cell deficient mice generated by targeted deletion of the JH locus," International Immunology, 5(6):647-656 (1993).

Cheung, R. C. et al., "Epitope-Specific Antibody Response to the Surface Antigen of Duck Hepatitis B Virus in Infected Ducks," Virology, 176:546-552 (1990).

(56) References Cited

OTHER PUBLICATIONS

Chia, C. W. et al., "Exogenous Glucose-Dependent Insulinotropic Polypeptide Worsens Postprandial Hyperglycemia in Type 2 Diabetes," Diabetes, 58:1342-1349 (2009).
Chothia & Lesk, "Canonical Structures for the Hypervariable Regions of Immunoglobulins," J. Mol. Biol., 196:901-917 (1987).
Chothia, C. et al., "Conformations of immunoglobulin hypervariable regions," Nature, 342:877-883 (1989).
Chou, P. Y. et al., "Conformational Parameters for Amino Acids in Helical, β-Sheet, and Random Coil Regions Calculated from Proteins," Biochemistry, 13(2):211-222 (1974).
Chou, P. Y. et al., "Empirical Predictions of Protein Conformation," Ann. Rev. Biochem., 47:251-276 (1978).
Chou, P. Y. et al., "Prediction of Protein Conformation," Biochem., 13(2):222-245 (1974).
Chou, P. Y. et al., "Prediction of the Secondary Structure of Proteins From Their Amino Acid Sequence," Adv. Enzymol. Relat. Areas Mol. Biol., 47:45-148 (1978).
Chou, P. Y. et al., "Prediction of β-Turns," Biophys. J., 26:367-384 (1979).
Cinti, S. et al., "Adipocyte death defines macrophage localization and function in adipose tissue of obese mice and humans," Journal of Lipid Research, 46:2347-2355 (2005).
Coligan, J. E., ed., Current Protocols in Immunology, New York: John Wiley & Sons, Inc. (1993) (Table of Contents Only).
Cosman, D. et al., "Cloning, sequence and expression of human interleukin-2 receptor," Nature, 312:768-771 (1984).
Creighton, T. E., Ed., Proteins: Structures and Molecular Principles, 2nd ed., W. H. Freeman and Company, New York (1984) (Table of Contents Only).
Creighton, T. E., Ed., Proteins: Structures and Molecular Principles, W. H. Freeman and Company, San Francisco, CA, Section About: Hydroxylation of Pro and Lys, pp. 70-86 (1983).
Dayhoff, M. O. et al., Atlas of Protein Sequence and Structure, Chapter 22, A Model of Evolutionary Change in Proteins, 5(3):345-352 (1978).
Devasher, R. B. et al., "Aqueous-phase, palladium-catelyzed croscoupling of aryl bromides under mid conditions, using water-soluble, sterically demanding alkylphosphines," J. Org. Chem., 69:7919-7927 (2004).
Devereux, J. et al., "A comprehensive set of sequence analysis programs for the VAX," Nucl. Acid Res., Laboratory of Genetics, University of Wisconsin, Madison, WI, 12(1):387-395 (1984).
Dibowski, H. et al., Bioconjugation of peptides by palladium-catalyzed C—C cross-coupling in water, Angew. Chem. Int. Ed., 37(4):476-478 (1998).
Dillon, J. S. et al., "Cloning and functional expression of the human glucagon-like peptide-1 (GLP-1) receptor," Endocrinology, 133(4):1907-1910 (1993).
Drucker, D. J., "Enhancing incretin action for the treatment of type 2 diabetes," Diabetes Care, 26(10):2929-2940 (2003).
Eng et al., "Purification and Structure of Exendin-3, a New Pancreatic Secretagogue Isolated from Heloderma horridum Venom," The Journal of Biological Chemistry, 265(33):20259-202262 (1990).
Eppstein, D. A. et al., "Biological activity of liposomes-encapsulated murine interferon γ is mediated by a cell membrane receptor," Proc. Natl. Acad. Sci. USA 82:3688-3692 (1985).
Evans, B. E. et al., "Design of Nonpeptidal Ligands for a Peptide Receptor: Cholecystokinin Antagonists," J. Med. Chem., 30:1229-1239 (1987).
Fairlie, W. D., "Expression of a TGF-β superfamily protein, macrophage inhibitory cytokine-1, in the yeast *Pichia pastoris*," Gene, 254:67-76 (2000).
Falko, J. M. et al., "Gastric Inhibitory Polypeptide (GIP) Stimulated by Fat Ingestion in Man," JCE&M, 41(2):260-265 (1975).
Fauchere, J-L., "Elements for the Rational Design of Peptide Drugs," Adv. Drug Res., 15:29-69 (1986).
Fehmann, H. et al. "Cell and Molecular Biology of the Incretin Hormones Glucagon-Like Peptide-I and Glucose-Dependent Insulin Releasing Polypeptide," Endocrine Reviews, 16(3):390-410 (1995).
Finan, B. et al., "Emerging Opportunities for the Treatment of Metabolic Diseases: Glucagon-Like Peptide-1 Based Multi-Agonists," Molecular and Cellular Endocrinology, 418: 42-54 (2015).
Finan, B. et al., "Unimolecular Dual Incretins Maximize Metabolic Benefits in Rodents, Monkeys, and Humans," Science—Translational Medicine, 5(209):209ra151 (2013).
Fishwild, D. M. et al., "High-avidity human IgGk monoclonal antibodies from a novel strain of minilocus transgenic mice," Nature Biotechnology, 14:845-851 (1996).
Fulurija, A. et al., "Vaccination against GIP for the Treatment of Obesity," PloS One, 3(9):e3163 (2008).
Gault, V. A. et al., "Characterization of the Cellular and Metabolic Effects of a Novel Enzyme-Resistant Antagonist of Glucose-Dependent Insulinotropic Polypeptide," Biochemical and Biophysical Research Communications, 290(5):1420-1426 (2002).
Genbank Accession No. U55762, "Cloning vector pEGFP-N1, complete sequence, enhanced green fluorescent protein (egfp) and neomycin phosphotransferase genes, complete cds," CLONTECH Labs, Inc., Kitts, P. A., (2003).
Gennaro, A. R., Remington's Pharmaceutical Sciences, 18th Edition, Mack Publishing Co., Easton, PA (1990) (Table of Contents Only).
Gerhard, D. S. et al., "The Status, Quality, and Expansion of the NIH Full-Length cDNA Project: The Mammalian Gene Collection (MGC)," Genome Research, 14:2121-2127 (2004).
Getty-Kaushik, L. et al., "Glucose-Dependent Insulinotropic Polypeptide Modulates Adipocyte Lipolysis and Reesterification," Obesity, 14(7):1124-1131 (2006).
Goding, Production of Monoclonal Antibodies, Monoclonal antibodies: principles and practice: production and application of monoclonal antibodies in cell biology, biochemistry, and immunology, pp. 59-103 (1986).
Goeddel, D. V., ed., Methods Enzymol., Gene Expression Technology, vol. 185, New York: Academic Press (1990) (Table of Contents Only).
Gonzalez, N.R., et al., "Minimizing the Immunogenicity of Antibodies for Clinical Application," Tumour Biol., 26(1):31-43 (2005).
Green, L. L. and Jakobovits, Aya, "Regulation of B Cell Development by Variable Gene Complexity in Mice Reconstituted with Human Immunoglobulin Yeast Artificial Chromosomes," J. Exp. Med., 188(3):483-495 (1998).
Green, L. L., et al., "Antigen-specific human monoclonal antibodies from mice engineered with human Ig heavy and light chain YACs," Nature Genetics, 7:13-21 (1994).
Gremlich, S. et al., "Cloning, Functional Expression, and Chromosomal Localization of the Human Pancreatic Islet Glucose-Dependent Insulinotropic Polypeptide Receptor," Diabetes, 44:1202-1208, (1995).
Gribskov, M. and Devereux, J., eds., Sequence Analysis Primer, New York: M. Stockton Press, (1991) (Table of Contents Only).
Gribskov, M. et al., "Profile Analysis, Searching Databases," Meth. Enzym., Chapter 9, 183:146-159 (1990).
Gribskov, M. et al., "Profile analysis: Detection of distantly related proteins," Proc. Nat. Acad. Sci. USA, 84:4355-4358 (1987).
Griffin, A. M. and Griffin, H. G., eds., Computer Analysis of Sequence Data, Part I, Humana Press, Totowa, New Jersey (1994) (Table of Contents Only).
Gupta, D. et al., "Physiologic and Pharmacologic Modulation of Glucose-Dependent Insulinotropic Polypeptide (GIP) Receptor Expression in β-Cells by Peroxisome Proliferator-Activated Receptor (PPAR)-γ Signaling: Possible Mechanism for the GIP Resistance in Type 2 Diabetes," Diabetes, 59:1445-1450 (2010).
Harding, F. A. and Lonberg, N., "Class Switching in Human Immunoglobulin Transgenic Mice," Ann. NY Acad. Sci., 765:536-546 (1995).
Hargrove, D. M. et al., "Biological activity of AC3174, a peptide analog of exendin-4," Regulatory Peptides, 141:113-119 (2007).

(56) References Cited

OTHER PUBLICATIONS

Harlow, E. and Lane, D., Antibodies: A Laboratory Manual, Cold Spring Harbor Laboratory Press, Cold Spring Harbor, NY (1988) (Ed. 1991 and Periodic Supplements) (Table of Contents Only).
Haugland, R. P., Molecular Probes Handbook, A Guide to Fluorescent Probes and Labeling Technologies, 11th Ed. Invitrogen by ThermoFisher Scientific (2010) (Table of Contents Only).
Hauner, H. et al., "Effects of Gastric Inhibitory Polypeptide on Glucose and Lipid Metabolism of Isolated Rat Adipocytes," Ann. Nutr. Metab., 32:282-288 (1988).
Heim, R. et al., "Engineering green fluorescent protein for improved brightness, longer wavelengths and fluorescence resonance energy transfer," Current Biology, 6:178-182 (1996).
Henikoff, S. et al., "Amino acid substitution matrices from protein blocks, " Proc. Natl. Acad. Sci. USA, 89:10915-10919 (1992).
Hinke, S. A. et al., Identification of a bioactive domain in the amino-terminus of glucose-dependent insulinotropic polypeptide (GIP), Biochimica et Biophysica Acta, 1547(1):143-155 (2001).
Højberg, P. V. et al., "Four weeks of near-normalisation or blood glucose improves the insulin response to glucagon-like peptide-1 and glucose-dependent insulinotropic polypeptide in patients with type 2 diabetes," Diabetologia, 52:199-207 (2009).
Holm, L. et al., "Protein folds and families: sequence and structure alignments," Nucleic Acid Research, 27(1):244-247 (1999).
Hoogenboom et al., "By-passing Immunisation Human Antibodies from Synthetic Repertoires of Germline VH Gene Segments Rearranged in Vitro," J. Mol. Biol., 227:381-388 (1991).
Hopp, T. P. et al., "A Short Polypeptide Marker Sequence Useful for Recombinant Protein Identification and Purification," Bio/Technology, 6:1204-1210 (1988).
Ichiki, T. et al., "Regulation of the expression of human C epsilon germline transcript. Identification of a novel IL-4 responsive element," The Journal of Immunology, 150:5408-5417 (1993).
Inagaki, N. et al., "Gastric Inhibitory Polypeptide: Structure and Chromosomal Localization of the Human Gene," Molecular Endocrinology 3(6):1014-1021 (1989).
International Search Report for PCT/US2016/068138, mailed Jun. 19, 2017, 14 pages.
International Search Report for PCT/US2018/013918, mailed Jun. 5, 2018, 8 pages.
International Search Report for PCT/US2018/038638, mailed Oct. 22, 2018, 7 pages.
International Search Report for PCT/US2018/038634, mailed Nov. 19, 2018, 10 pages.
Jakobovits, A. et al., "Analysis of homozygous mutant chimeric mice: deletion of the immunoglobulin heavy-chain joining region blocks B-cell development and antibody production," Proc. Natl. Acad. Sci. USA, 90:2551-2555 (1993).
Jakobovits, A. et al., "Germ-line transmission and expression of a human-derived yeast artificial chromosome," Nature, 362:255-258 (1993).
Jalkanen, M. et al., "Cell Surface Proteoglycan of Mouse Mammary Epithelial Cells is Shed by Cleavage of Its Matrix-binding Ectodomain from Its Membrane-associated Domain," The Journal of Cell Biology, 105(6)(2):3087-3096 (1987).
Jalkanen, M. et al., "Heparan Sulfate Proteoglycans from Mouse Mammary Epithelial Cells: Localization on the Cell Surface with a Monoclonal Antibody," The Journal of Cell Biology, 101:976-984 (1985).
Jones, D. T. et al., "Progress in protein structure prediction," Current Opinion in Structural Biology, 7:377-387 (1997).
Jones, P. T. et al., "Replacing the complementarity-determining regions in a human antibody with those from a mouse," Nature, 321:522-525 (1986).
Joo, E. et al., "Inhibition of Gastric Inhibitory Polypeptide Receptor Signaling in Adipose Tissue Reduces Insulin Resistance and Hepatic Steatosis in High-Fat Diet-Fed Mice," Diabetes, 66:868-879 (2017).
Kabat, E. A. et al., Sequences of Proteins of Immunological Interest, 5th ed., U.S. Dept. of Health and Human Services, PHS, NIH, Bethesda, MD (1987 and 1991) (Table of Contents Only).
Kabat, E. A. et al., Sequences of Proteins of Immunological Interest, 5th ed., U.S. Dept. of Health and Human Services, PHS, NIH, NIH Publication No. 91-3242, Bethesda, MD (1991) (Table of Contents Only).
Kellerman, S. and Green, L. L., "Antibody discovery: the use of transgenic mice to generate human monoclonal antibodies for therapeutics," Current Opinion in Biotechnology, 13:593-597 (2002).
Kennett, R. H. et al., eds., Monoclonal Antibodies, Hybridomas: A New Dimension in Biological Analyses, Plenum Press, New York (1980) (Table of Contents Only).
Kilpatrick, K. E. et al., "Rapid development of affinity matured monoclonal antibodies using RIMMS," Hybridoma, 16(4):381-389 (1997).
Kim, S. J. et al., "Activation of Lipoprotein Lipase by Glucose-dependent Insulinotropic Polypeptide in Adipocytes: A Role for a Protein Kinase B, LKB1, and AMP-Activated Protein Kinase Cascade," The Journal of Biological Chemistry, 282(12):8557-8567 (2007).
Kim, S. J. et al., "GIP-Overexpressing Mice Demonstrate Reduced Diet-Induced Obesity and Steatosis, and Improved Glucose Homeostasis," PloS One, 7(7):e40156 (2012).
Kirkland, T. N. et al., "Analysis of the Fine Specificity and Cross-Reactivity of Monoclonal Anti-Lipid A Antibodies," The Journal of Immunology, 137(11):3614-3619 (1986).
Knapper, J. M. et al., "Investigations into the Actions of Glucose-Dependent Insulinotropic Polypeptide and Glucagon-Like Peptide-1(7-36)amide on Lipoprotein Lipase Activity in Explants of Rat Adipose Tissue," The Journal of Nutrition, 125(2):183-188 (1995).
Kostelny, S. A. et al., "Formation of a Bispecific Antibody by the Use of Leucine Zippers," The Journal of Immunology, 148(5):1547-1553 (1992).
Kyte, J. et al., "A Simple Method for Displaying the Hydropathic Character of a Protein," J. Mol. Biol., 157:105-132 (1982).
Langer, R. et al., "Biocompatibility of polymeric delivery systems for macromolecules," Journal of Biomedical Materials. Research, 15:267-277 (1981).
Langer, R. et al., "Controlled release of macromolecules," Chem. Tech., 12:98-105 (1982).
Lesk, A. M., ed., Computational Molecular Biology, Sources and Methods for Sequence Analysis, New York: Oxford University Press, Oxford New York Tokyo (1988) (Table of Contents Only).
Lewis, J. T. et al. "Glucose-dependent insulinotropic polypeptide confers early phase insulin release to oral glucose in rats: demonstration by a receptor antagonist", Endocrinology, 141(10): 3710-3716 (2000).
Link, A. J. et al., "Non-canonical amino acids in protein engineering," Current Opinion in Biotechnology, 14(6):603-609 (2003).
Lonberg, N. and Huszar, D., "Human Antibodies from Transgenic Mice," Intern. Rev. Immunol., 13:65-93 (1995).
Lonberg, N. et al., "Antigen-specific human antibodies from mice comprising four distinct genetic modifications," Nature, 368:856-859 (1994).
Lonberg, N. et al., The Pharmacology of Monoclonal Antibodies—Chapter 3: "Transgenic Approaches to Human Monoclonal Antibodies," Handbook of Exp. Pharmacology, 113:49-101 (1994).
Lorenz, M. et al., "Recent progress and future options in the development of GLP-1 receptor agonists for the treatment of diabesity," Bioorg Med Chem Lett, 23(14):4011-4018 (2013).
Lund, A. et al., "The separate and combined impact of the intestinal hormones, GIP, GLP-1, and GLP-2, on glucagon secretion in type 2 diabetes," Am J Physiol Endocrinol Metab, 300:E1038-E1046 (2011).
Manandhar, B. and Ahn, J., "Glucagon-like Peptide 1 (GLP-1) Analogs: Recent Advances, New Possibilities, and Therapeutic Implications," J. Med. Chem., 58(3):1020-1037 (2015).
Maniatis et al., "Regulation of Inducible and Tissue-Specific Gene Expression," Science, 236:1237-1244 (1987).
Marks, J. D. et al., "By-passing Immunization: Human Antibodies and V-gene Libraries Displayed on Phage," J. Mol. Biol., 222:581-597 (1991).
Meier, J. J. et al., "Gastric inhibitory polypeptide (GIP) dose-dependently stimulates glucagon secretion in healthy human subjects at euglycaemia," Diabetologia, 46:798-801 (2003).

(56) References Cited

OTHER PUBLICATIONS

Mendez et al., "Functional transplant of megabase human immunoglobulin loci recapitulates human antibody response in mice," Nature Genetics, 15:146-156 (1997).
Miyawaki, K. et al., "Inhibition of gastric inhibitory polypeptide signaling prevents obesity," Nature Medicine, 8(7):738-742 (2002).
Mohammad, S. et al., "A Naturally Occurring GIP Receptor Variant Undergoes Enhanced Agonist-Induced Desensitization, Which Impairs GIP Control of Adipose Insulin Sensitivity," Molecular and Cellular Biology, 34(19):3618-3629 (2014).
Moldenhauer, G. et al., "Identity of HML-1 Antigen on Intestinal Intraepithelial T Cells and of B-ly7 Antigen on Hairy Cell Leukaemia," Scand. J. Immunol., 32:77-82 (1990).
Montgomery, I. A. et al., "Active immunization against (Pro(3))GIP improves metabolic status in high-fat-fed mice," Diabetes, Obesity & Metabolism, pp. 744-751 (2010).
Morel et al., "Monoclonal Antibodies to Bovine Serum Albumin: Affinity and Specificity Determinations," Molecular Immunology, 25(1):7-15 (1988).
Morrison, S. L. et al., "Chimeric human antibody molecules: Mouse antigen-binding domains with human constant region domains," Proc. Natl. Acad. Sci. USA, 81:6851-6855 (1984).
Moult, J. et al., "The current state of the art in protein structure prediction," Current Opinion in Biotechnology, 7:422-427 (1996).
Murphy, M. C. et al., "Postprandial lipid and hormone responses to meals of varying fat contents: modulatory role of lipoprotein lipase?," European Journal of Clinical Nutrition, 49:579-588 (1995).
Nasteska, D. et al., "Chronic Reduction of GIP Secretion Alleviates Obesity and Insulin Resistance Under High-Fat Diet Conditions," Diabetes, 63:2332-2343 (2014).
Nauck, M. A. et al., "Preserved Incretin Activity of Glucagon-like Peptide 1 [7-36 Amide] but Not of Synthetic Human Gastric Inhibitory Polypeptide in Patients with Type-2 Diabetes Mellitus," J. Clinic. Invest., 91:301-307 (1993).
NCBI Reference Sequence: AAI20674, https://www.ncbi.nlm.nih.gov/sviewer/viewer.fcgi?db=nuccore&val=AAI20674&report=genbank, (downloaded Nov. 28, 2017).
NCBI Reference Sequence: NM_000164, https://www.ncbi.nlm.nih.gov/sviewer/viewer.fcgi?noredirect=1&db-nuccore&val=NM_000164.1, (downloaded Nov. 28, 2017).
NCBI Reference Sequence: NM_001080815, https://www.ncbi.nlm.nih.gov/sviewer/viewer.fcgi?db=protein&val=NM_001080815&report=genbank, (downloaded Nov. 28, 2017).
NCBI Reference Sequence: NP_000155, https://www.ncbi.nlm.nih.gov/protein/NP_000155.1 (downloaded Aug. 16, 2018).
NCBI Reference Sequence: NP_001074284, https://www.ncbi.nlm.nih.gov/sviewer/viewer.fcgi?db=protein&val=NP_001074284+&report=genbank, (downloaded Nov. 28, 2017).
NCBI Reference Sequence: XP_005258790, https://www.ncbi.nlm.nih.gov/sviewer/viewer.fcgi?db=nuccore&val=XP_005258790&report=genbank, (downloaded Nov. 28, 2017).
Needleman, S. B. et al., Algorithm, "A General Method Applicable to the Search for Similarities in the Amino Acid Sequence of Two Proteins," J. Mol. Biol., 48:443-453 (1970).
Nielsen, L. L. et al., "Pharmacology of exenatide (synthetic exendin-4) for the treatment of type 2 diabetes," Current Opinion in Investigational Drugs, 4(4):401-405 (2003).
Nolan, G. P. et al., "Flourescence-activated cell analysis and sorting of viable mammalian cells based on beta-D-galactosidase activity after transduction of *Escherichia coli* lacZ," Proc. Natl. Acad. Sci. USA, 85:2603-2607 (1988).
Okada, Y. et al., "Common variants at CDKAL1 and KLF9 are associated with body mass index in east Asian populations," Nature Genetics, 44(3):302-306 (2012).
Paul, W. E. et al., Fundamental Immunology, 2nd ed., Chapter 7: Evolution of the Immune System, pp. 139-165, Raven Press, New York (1989).
Prasad-Reddy, L. et al., "A clinical review of GLP-1 receptor agonists: efficacy and safety in diabetes and beyond," Drugs in Context, 4:212283 (2015).
Prescher, J. A., and Bertozzi, C. R., Chemistry in living systems, Nature Chemical Biology, 1(1):13-21 (2005).
Raufman, J. P. et al., "Truncated Glucagon-like Peptide-1 Interacts with Exendin Receptors on Dispersed Acini from Guinea Pig Pancreas," The Journal of Biological Chemistry, 265(30):21432-21437 (1992).
Ravn, P. et al., "Structural and Pharmacological Characterization of Novel Potent and Selective Monoclonal Antibody Antagonists of Glucose-dependent Insulinotropic Polypeptide Receptor," The Journal of Biological Chemistry, 288(27):19760-19772, (2013).
Riechmann, L. et al., "Reshaping human antibodies for therapy," Nature, 332(24):323-327 (1988).
Rizo, J. and Gierasch, L. M., "Constrained Peptides: Models of Bioactive Peptides and Protein Substructures," Annual Rev. Biochem., 61:387-418 (1992).
Rudikoff, S. et al., "Single amino acid substitution altering antigen-binding specificity," Proc. Natl. Acad. Sci., 79:1979-1983 (1982).
Sambrook, J. et al., Molecular Cloning: A Laboratory Manual, 2nd ed., Cold Spring Harbor Laboratory Press (1989) (Table of Contents Only).
Sambrook, J. et al., Molecular Cloning: A Laboratory Manual, 3rd ed., Cold Spring Harbor Laboratory Press, Cold Spring Harbor, NY (2001) (Table of Contents Only).
Saxena, R. et al., "Genetic variation in GIPR influences the glucose and insulin responses to an oral glucose challenge," Nature Genetics, 42(2):142-148 (2010).
Schumacher, D. et al., "Current Status: Site-Specific Antibody Drug Conjugates," Journal of Clinical Immunology, 36(1):100-107 (2016).
Shinmi, D. et al., "One-Step Conjugation Method for Site-Specific Antibody-Drug Conjugates through Reactive Cysteine-Engineered Antibodies," Bioconjugate Chem, 27(5):1324-1331 (2016).
Sidman, K. R. et al., "Controlled Release of Macromolecules and Pharmaceuticals from Synthetic Polypeptides Based on Glutamic Acid," Biopolymers, 22:547-556 (1983).
Sippl, Manfred J. et al., "Threading thrills and threats," Structure, 4:15-19 (1996).
Smith, D. W., ed., Biocomputing Informatics and Genome Projects, New York: Academic Press (1994) (Table of Contents Only).
Songsivilai, S. and Lachmann, P. J., "Bispecific antibody: a tool for diagnosis and treatment of disease," Clin. Exp. Immunol., 79:315-321 (1990).
Speliotes, E. K. et al., "Association analyses of 249,796 individuals reveal 18 new loci associated with body mass index," Nature Genetics, 42(11):937-948 (2010).
Stahli, C. et al., "Distinction of Epitopes by Monoclonal Antibodies," Methods in Enzymology, 92:242-253 (1983).
Stauber, R. H., "Developments and Applications of Enhanced Green Fluorescent Protein Mutants," BioTechniques, 24(3):462-471 (1998).
Strissel, K. J. et al., "Adipocyte Death, Adipose Tissue Remodeling, and Obesity Complications," Diabetes, 56:2910-2918 (2007).
Suzuki, K. et al., "Transcriptional Regulatory Factor X6 (Rfx6) Increases Gastric Inhibitory Polypeptide (GIP) Expression in Enteroendocrine K-cells and Is Involved in GIP Hypersection in High Fat Diet-induced Obesity," The Journal of Biological Chemistry, 288(3): 1929-1938 (2013).
Taylor, L. D. et al., "A Transgenic mouse that expresses a diversity of human sequence heavy and light chain immunoglobulins," Nucleic Acids Research, 20(23):6287-6295 (1992).
Taylor, L. D. et al., "Human immunoglobulin transgenes undergo rearrangement, somatic mutation and class switching in mice that lack endogenous IgM," International Immunology, 6(4):579-591 (1994).
Third Report of the National Cholesterol Education Program (NCEP) Expert Panel on Detection, Evaluation, and Treatment of the High Blood Cholesterol in Adults (adult Treatment Panel III) Final Report, National Institutes of Health, NIH Publication No. 02-5215 (2002).
Thornton, J. M. et al., "Prediction of progress at last," Nature, 354:105-106 (1991).
Tijssen, Practice and Theory of Enzyme Immunoassays, R. H. Burdon and P. H. van Knippenberg, Eds, Elsevier, Amsterdam, vol. 15 (1993) (Table of Contents Only).

(56) References Cited

OTHER PUBLICATIONS

Trumper, A. et al., "Glucose-Dependent Insulinotropic Polypeptide Is a Growth Factor for β (INS-1) Cells by Pleiotropic Signaling," Molecular Endocrinology, 15(9):1559-1570 (2001).
Tseng, C. C. et al., "Regulation of glucose-dependent insulinotropic peptide gene expression by a glucose meal," Am J Physiol, 266(5)(1):G887-891 (1994).
Tsubamoto, Y. et al., "A novel low-molecular-weight antagonist of glucose-dependent insulinotropic polypeptide receptor SKL-14959, prevents obesity and insulin resistance," Diabetologia, 51:S373 (2008).
Tuaillon et al., "Biased utilization of DHQ52 and JH4 gene segments in a human Ig transgenic minilocus is independent of antigenic selection," The Journal of Immunology, 152:2912-2920 (1994).
UniProtKB Sequence Identifier: P48546-2, http://www.uniprot.org/uniprot/P48546-2.fasta, downloaded Nov. 30, 2017.
UniprotKB/Swiss-Prot Q0P543-1, http://www.uniprot.org/uniprot/Q0P543.fasta, downloaded Dec. 4, 2017.
Usdin, T. B. et al., "Gastric Inhibitory Polypeptide Receptor, a Member or the Secretin-Vasoactive Intestinal Peptide Receptor Family, Is Widely Distributed in Peripheral Organs and the Brain," Endocrinology, 133(6):2861-2870 (1993).
Van Heeke, G. & Schuster, S. M., "Expression of Human Asparagine Synthetase in *Escherichia coli*," The Journal of Biological Chemistry, 264(10):5503-5509 (1989).
Vassilatis et al., "The G Protein-coupled receptor repertoires of human and mouse," PNAS USA, 100(8):4903-4908 (2003).
Veber, D. F. and Freidinger, R. M., "The design of metabolically-stable peptide analogs," TINS, p. 392-396 (1985).
Verhoeyen, M. et al., "Reshaping Human Antibodies: Grafting an Antilysozyme Activity," Science, 239:1534-1536 (1988).
Vilsboll, T. et al., "Incretin Secretion in Relation to Meal Size and Body Weight in Healthy Subjects and People with Type 1 and Type 2 Diabetes Mellitus," The Journal of Clinical Endocrinology & Metabolism, 88(6):2706-2713 (2003).
Volz, A. et al., "Molecular cloning, functional expression, and signal transduction of the GIP-receptor cloned from a human insulinoma," FEBS Letters, 373:23-29 (1995).
Von Heinje, G., Sequence Analysis in Molecular Biology, Academic Press, Inc., New York (1987) (Table of Contents Only).
Voss, S. D. et al., "The role of enhancers in the regulation of cell-type-specific transcriptional control," TIBS, 11:287 (1986).
Wang, Y. et al., "Multifunctional Antibody Agonists Targeting Glucagon-like Peptide-1, Glucagon, and Glucose-Dependent Insulinotropic Polypeptide Receptors," Angewandte Chemie International Edition, 55(40): 12475-12478 (2016).
Wen, W. et al., "Meta-analysis identifies common variants associated with body mass index in east Asians," Nature Genetics, 44(3):307-311 (2012).
Western, E. C. (Including Shaugnessy, K. H. as shown in specification) et al., "Efficient One-Step Suzuki Arylation of Unprotected Halonucleosides, Using Water-Soluble Palladium Catalysts," J. Org. Chem., 68:6767-6774 (2003).
Written Opinion for PCT/US2016/068138, mailed Jun. 19, 2017, 17 pages.
Written Opinion for PCT/US2018/013918, mailed Jun. 5, 2018, 8 pages.
Written Opinion for PCT/US2018/038638, mailed Oct. 22, 2018, 11 pages.
Written Opinion for PCT/US2018/038634, mailed Nov. 19, 2018, 12 pages.
Wu, H., et al., "Humanization of a Murine Monoclonal Antibody by Simultaneous Optimization of Framework and CDR Residues," J. Mol. Biol., 294: 151-162 (1999).
Yamada, Y. et al., "Pancreatic and Extrapancreatic Effects of Gastric Inhibitory polypeptide," Diabetes, 55(2):S86-S91 (2006).
Yip, R. G. et al., "Functional GIP Receptors are Present on Adipocytes," Endocrinology, 139(9):4004-4007 (1998).
Yutaka, S. et al., "Glucose-dependent insulinotropic polypeptide and glucagon-like peptide-1: Incretin actions beyond the pancreas", Journal of Diabetes Investigation, 4(2):108-130 (2013).
Zola, H., Monoclonal Antibodies: A Manual of Techniques, "Using Monoclonal Antibodies: Soluble Antigens," CRC Press, Inc., Chapter 6, pp. 147-181 (1987).
De La Lastra et al., "Epitope mapping of 10 monoclonal antibodies against the pig analogue of human membrane cofactor protein (MCP)," *Immunology* 96(4):663-670 (1999).
Klein et al., "Epitope interactions of monoclonal targeting CD20 and their relationship to functional properties," *mAbs* 5(1):22-33 (2013).
Mcclean, P. L. et al., "GIP receptor antagonism reverses obesity, insulin resistance, and associated metabolic disturbances induced in mice by prolonged consumption of high-fat diet," *American Journal of Physiology: Endocrinology and Metabol*, American Physiological Society, Bethesda, MD, US, 293(6): E1746-E1755 (2007).
Wang, Y. J. and Hanson, M. A. et al., "Parenteral Formulations of Proteins and Peptides: Stability and Stabilizers," *Journal of Parenteral Science and Technology*, Technical Report No. 10, 42(2S): S4-S26 (1988).
Crofts, C. A. P. et al., "Hyperinsulinemia: Best management practice," Diabesity, vol. 2(1):1-11 (2016).
Parmir, N., "Glucose-dependent insulinotropic polypeptide receptor null mice exhibit compensatory changes in the enteroinsular axis," American Journal of Physiology: Endocrinology and Metabolism, 284:E931-E939 (2003).

* cited by examiner

FIG. 1A

| | GLP1 activity | | | H | A | E | G | T | F | T | S | D | V | S | S | Y | L | E | G | Q | A | A | K | E | F | I | A | W | L | V | K | G | | |
|---|---|---|---|---|---|---|---|---|---|---|---|---|---|---|---|---|---|---|---|---|---|---|---|---|---|---|---|---|---|---|---|---|---|---|
| Amgen# | EC50 (M) | EC50 (pM) | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 |
| 3166733#1 | 3.48E-10 | 347.9 | | H | G | A | G | T | F | T | S | D | V | S | S | Y | L | E | G | Q | A | A | K | E | F | I | A | W | L | V | K | G | | |
| 3166734#1 | 4.40E-12 | 4.4 | | H | G | D | G | T | F | T | S | D | V | S | S | Y | L | E | G | Q | A | A | K | E | F | I | A | W | L | V | K | G | | |
| 3166735#1 | 9.65E-11 | 96.5 | | H | G | L | G | T | F | T | S | D | V | S | S | Y | L | E | G | Q | A | A | K | E | F | I | A | W | L | V | K | G | | |
| 3166736#1 | 8.38E-11 | 83.8 | | H | G | V | G | T | F | T | S | D | V | S | S | Y | L | E | G | Q | A | A | K | E | F | I | A | W | L | V | K | G | | |
| 3166737#1 | 3.04E-09 | 3039 | | H | G | F | G | T | F | T | S | D | V | S | S | Y | L | E | G | Q | A | A | K | E | F | I | A | W | L | V | K | G | | |
| 3166738#1 | 2.83E-09 | 2831 | | H | G | Y | G | T | F | T | S | D | V | S | S | Y | L | E | G | Q | A | A | K | E | F | I | A | W | L | V | K | G | | |
| 3166739#1 | 1.62E-10 | 161.7 | | H | G | T | G | T | F | T | S | D | V | S | S | Y | L | E | G | Q | A | A | K | E | F | I | A | W | L | V | K | G | | |
| 3166740#1 | 2.80E-10 | 280.2 | | H | G | N | G | T | F | T | S | D | V | S | S | Y | L | E | G | Q | A | A | K | E | F | I | A | W | L | V | K | G | | |
| | | | | | | | | | | | | | | | | | | | | | | | | | | | | | | | | | | |
| 3166741#1 | 5.37E-12 | 5.4 | | H | G | H | G | T | F | T | S | D | V | S | S | Y | L | E | G | Q | A | A | K | E | F | I | A | W | L | V | K | G | | |
| 3166742#1 | 6.07E-09 | 6070 | | H | G | K | G | T | F | T | S | D | V | S | S | Y | L | E | G | Q | A | A | K | E | F | I | A | W | L | V | K | G | | |
| 3166743#1 | 5.38E-11 | 53.8 | | H | G | I | G | T | F | T | S | D | V | S | S | Y | L | E | G | Q | A | A | K | E | F | I | A | W | L | V | K | G | | |
| 3166744#1 | 2.82E-09 | 2823 | | H | G | W | G | T | F | T | S | D | V | S | S | Y | L | E | G | Q | A | A | K | E | F | I | A | W | L | V | K | G | | |
| 3166745#1 | 3.76E-10 | 375.7 | | H | G | P | G | T | F | T | S | D | V | S | S | Y | L | E | G | Q | A | A | K | E | F | I | A | W | L | V | K | G | | |
| 3166747#1 | 4.26E-10 | 426.4 | | H | G | S | G | T | F | T | S | D | V | S | S | Y | L | E | G | Q | A | A | K | E | F | I | A | W | L | V | K | G | | |
| 3166748#1 | 1.40E-09 | 1395 | | H | G | R | G | T | F | T | S | D | V | S | S | Y | L | E | G | Q | A | A | K | E | F | I | A | W | L | V | K | G | | |
| 3166749#1 | 6.69E-11 | 66.9 | A | H | G | E | G | T | F | T | S | D | V | S | S | Y | L | E | G | Q | A | A | K | E | F | I | A | W | L | V | K | G | | |
| | | | | | | | | | | | | | | | | | | | | | | | | | | | | | | | | | | |
| 3166961#1 | 2.05E-10 | 205.2 | G | H | G | E | G | T | F | T | S | D | V | S | S | Y | L | E | G | Q | A | A | K | E | F | I | A | W | L | V | K | G | | |
| 3166962#1 | 3.63E-10 | 363.1 | H | H | G | E | G | T | F | T | S | D | V | S | S | Y | L | E | G | Q | A | A | K | E | F | I | A | W | L | V | K | G | | |
| 3166963#1 | 5.85E-10 | 585.2 | | H | H | E | G | T | F | T | S | D | V | S | S | Y | L | E | G | Q | A | A | K | E | F | I | A | W | L | V | K | G | | |
| 3166964#1 | 3.51E-09 | 3508 | | H | G | E | A | T | F | T | S | D | V | S | S | Y | L | E | G | Q | A | A | K | E | F | I | A | W | L | V | K | G | | |
| 3166965#1 | 4.98E-09 | 4978 | | H | G | E | S | T | F | T | S | D | V | S | S | Y | L | E | G | Q | A | A | K | E | F | I | A | W | L | V | K | G | | |
| 3166966#1 | 5.53E-08 | 55300 | | H | G | E | V | T | F | T | S | D | V | S | S | Y | L | E | G | Q | A | A | K | E | F | I | A | W | L | V | K | G | | |
| 3166967#1 | ~ 4.69e-005 | ~ 46870000 | | H | G | E | K | T | F | T | S | D | V | S | S | Y | L | E | G | Q | A | A | K | E | F | I | A | W | L | V | K | G | | |
| 3166968#1 | 9.87E-08 | 98710 | | H | G | E | E | T | F | T | S | D | V | S | S | Y | L | E | G | Q | A | A | K | E | F | I | A | W | L | V | K | G | | |

FIG. 1B

| | GLP1 activity | | | H | A | E | G | T | F | T | S | D | V | S | S | Y | L | E | G | Q | A | A | K | E | F | I | A | W | L | V | K | G | | |
|---|---|---|---|---|---|---|---|---|---|---|---|---|---|---|---|---|---|---|---|---|---|---|---|---|---|---|---|---|---|---|---|---|---|---|
| Amgen# | EC50 (M) | EC50 (pM) | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 |
| 3161008#1 | | 6.2 | | H | G | E | G | T | F | T | S | D | V | S | S | Y | L | E | G | Q | A | A | K | E | F | I | A | W | L | V | K | G | | |
| 3161010#1 | | 10.7 | | H | V | E | G | T | F | T | S | D | V | S | S | Y | L | E | G | Q | A | A | K | E | F | I | A | W | L | V | K | G | R | G |
| 3161011#1 | | 3.4 | | H | S | E | G | T | F | T | S | D | V | S | S | Y | L | E | G | Q | A | A | K | E | F | I | A | W | L | V | K | G | R | G |
| 3161012#1 | | 4.1 | | H | G | Q | G | T | F | T | S | D | V | S | S | Y | L | E | G | Q | A | A | K | E | F | I | A | W | L | V | K | G | R | G |

FIG. 2

| Amgen# | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 | 36 | 37 | hGLP1R EC50 (pM) |
|---|---|---|---|---|---|---|---|---|---|---|---|---|---|---|---|---|---|---|---|---|---|---|---|---|---|---|---|---|---|---|---|---|
| 3159823#1 | H | A | E | G | T | F | T | S | D | V | S | S | Y | L | E | G | Q | A | A | K | E | F | I | A | W | L | V | K | G | R | G | 2.12 |
| 1119185#3 | H | A | E | G | T | F | T | S | D | V | S | S | Y | L | E | G | Q | A | A | K | E | F | I | A | W | L | V | K | G | R | G | 2.35 |
| 3161005#1 | | A | E | G | T | F | T | S | D | V | S | S | Y | L | E | G | Q | A | A | K | E | F | I | A | W | L | V | K | G | R | G | 3005 |
| 3161006#1 | | | E | G | T | F | T | S | D | V | S | S | Y | L | E | G | Q | A | A | K | E | F | I | A | W | L | V | K | G | R | G | 40000 |
| 1062072#3 | H | G | E | G | T | F | T | S | D | V | S | S | Y | L | E | G | Q | A | A | K | E | F | I | A | W | L | V | K | G | R | G | 5.2 |
| 3161007#1 | H | G | E | G | T | F | T | S | D | V | S | S | Y | L | E | G | Q | A | A | K | E | F | I | A | W | L | V | K | G | R | | 6.5 |
| 3161008#1 | H | G | E | G | T | F | T | S | D | V | S | S | Y | L | E | G | Q | A | A | K | E | F | I | A | W | L | V | K | G | | | 6.2 |
| 3161009#1 | H | L | E | G | T | F | T | S | D | V | S | S | Y | L | E | G | Q | A | A | K | E | F | I | A | W | L | V | K | G | R | G | 1021 |
| 3161010#1 | H | V | E | G | T | F | T | S | D | V | S | S | Y | L | E | G | Q | A | A | K | E | F | I | A | W | L | V | K | G | R | G | 10.7 |
| 3161011#1 | H | S | E | G | T | F | T | S | D | V | S | S | Y | L | E | G | Q | A | A | K | E | F | I | A | W | L | V | K | G | R | G | 3.4 |
| 3161012#1 | H | G | Q | G | T | F | T | S | D | V | S | S | Y | L | E | G | Q | A | A | K | E | F | I | A | W | L | V | K | G | R | G | 4.1 |

- > 1000-fold potency decrease with truncation of single N-terminal residue.
- Truncation to Gly35 well tolerated and eliminates potential Arg36 trypsin site.
- His-Ala is the DPP-IV recognition sequence. Minimal impact when Ala8 substituted with Gly, Val, and Ser, but 500-fold decrease when substituted with Leu.
- Replacement of Glu9 with Gln does not shift potency and may reduce Gly8-Glu9 cleavage observed in vivo from mouse.

Ab: 6H1 HC

Linker: 1Kmod

GLP1: (A2G/E3H/R30G), (A2V/E3H/R30G), (A2S/E3H/R30G), (A2G/E3D/R30G), (A2V/E3D/R30G), (A2S/E3D/R30G), (0A/A2G/R3OG), (A2V/R30G), (A2S/R30G), (A2G/E3Q/R30G), (A2V/E3Q/R30G), (A2S/E3Q/R30G)

α -GIPR mAb
6H1-HC

FIG. 4

| | Construct | Lot | GLP1 $EC_{50}$ (pM) | GIPR $IC_{50}$ (nM) | Yield (g/L) | SEC (%MP) | MS Purified |
|---|---|---|---|---|---|---|---|
| | (A2V/R30G) | PL-45559 | 126 | 146 | 148 | 98 | NT-clip |
| → | (A2S/R30G) | PL-45560 | 35 | 189 | 20 | 97 | |
| | (A2G/E3Q/R30G) | PL-45561 | 37 | 404 | 36 | 98 | |
| | (A2V/E3Q/R30G) | PL-45562 | 97 | 221 | 33 | 98 | |
| → | (A2S/E3Q/R30G) | PL-45563 | 56 | 693 | 98 | 99 | |
| | (A2G/E3H/R30G) | PL-45565 | 30 | 241 | 20 | 99 | NT-clip |
| | (A2V/E3H/R30G) | PL-45567 | 43 | 212 | 31 | 99 | NT-clip |
| | (A2S/E3H/R30G) | PL-45569 | 26 | 187 | 78 | 99 | |
| | (A2V/E3D/R30G) | PL-45564 | 48 | 273 | 133 | 99 | |
| → | (A2G/E3D/R30G) | PL-45570 | 31 | 292 | 82 | 99 | |
| → | (A2S/E3D/R30G) | PL-45571 | 21 | 468 | 107 | 98 | |
| | (0A/A2G/R30G) | PL-45572 | 88 | 200 | 146 | 99 | |

FIG. 5A
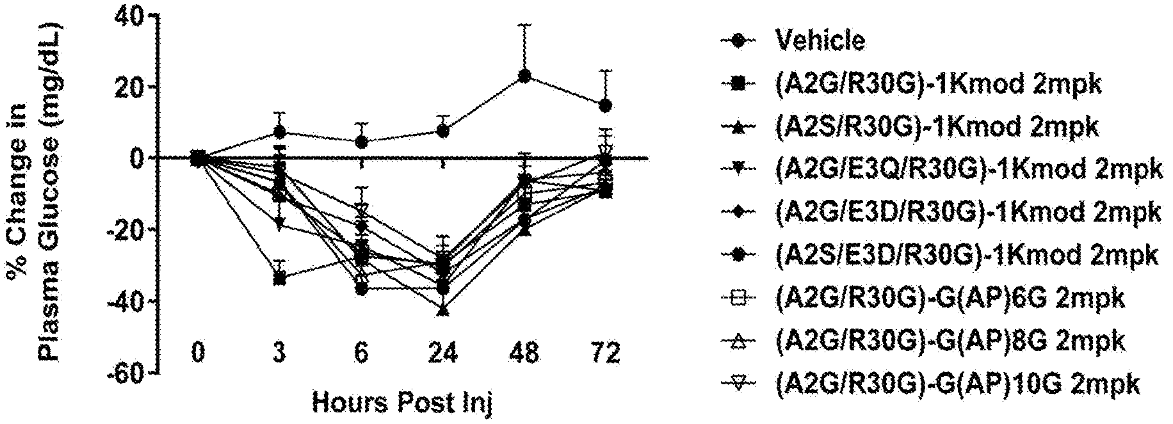
FIG. 5B
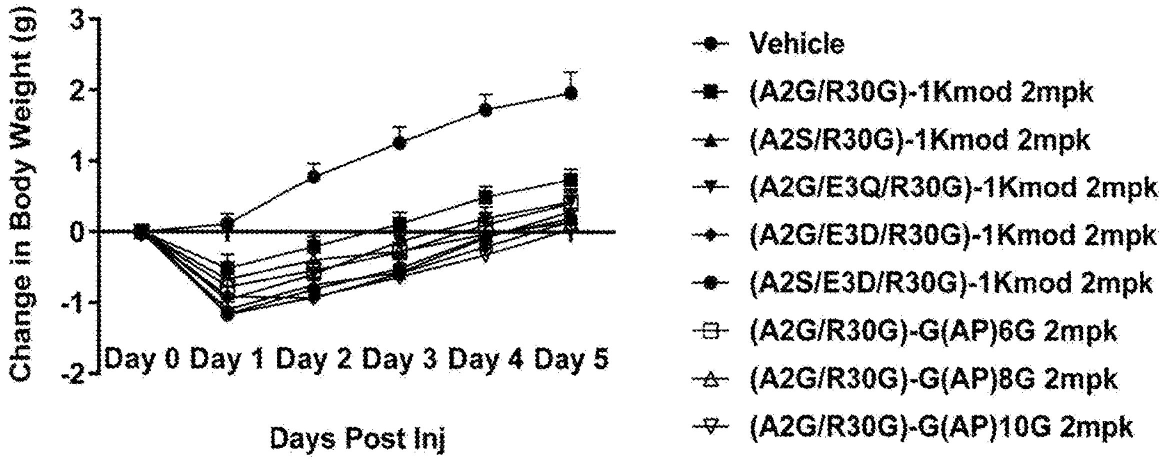
FIG. 5C
| Biologic Lot or Reg # | Description | Linker / Ab Site |
|---|---|---|
| PL-42834 | GLP1 (A2G/R30G)-1Kmod 6H1(HC) | 1Kmod - 6H1-HC |
| PL-45560 | GLP1 (A2S/R30G)-1Kmod 6H1(HC) | 1Kmod - 6H1-HC |
| PL-45561 | GLP1 (A2G/E3Q/R30G)-1Kmod 6H1(HC) | 1Kmod - 6H1-HC |
| PL-45570 | GLP1 (A2G/E3D/R30G)-1Kmod 6H1(HC) | 1Kmod - 6H1-HC |
| PL-45571 | GLP1 (A2S/E3D/R30G)-1Kmod 6H1(HC) | 1Kmod - 6H1-HC |
| PL-45582 | GLP1 (A2G/R30G)-G(AP)8G-6H1(HC) | G(AP)8G - 6H1-HC |
| PL-45581 | GLP1 (A2G/R30G)-G(AP)6G-6H1(HC) | G(AP)6G - 6H1-HC |
| PL-45583 | GLP1 (A2G/R30G)-G(AP)10G-6H1(HC) | G(AP)10G - 6H1-HC |

FIG. 6A
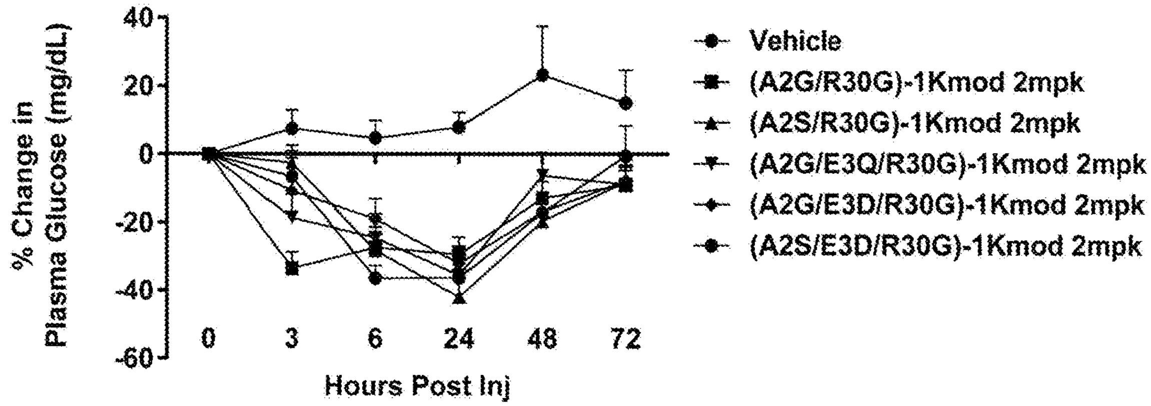
FIG. 6B
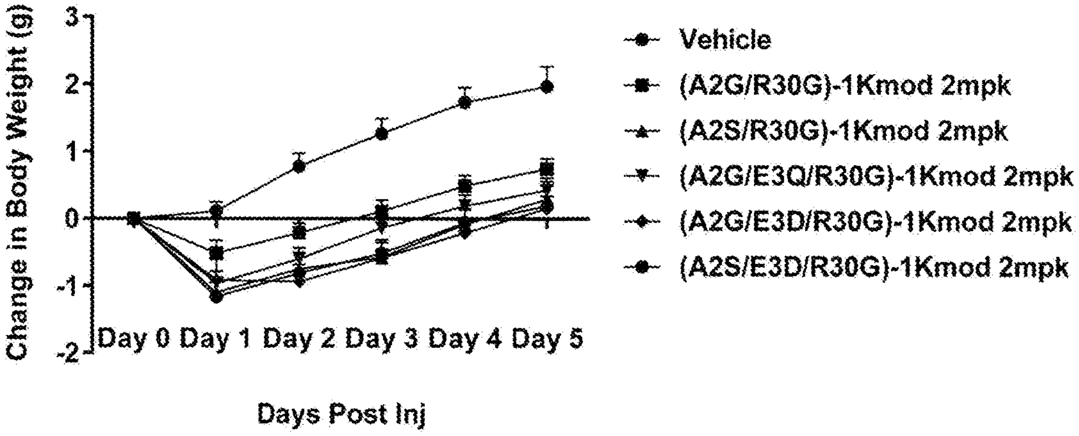
FIG. 6C
| Biologic Lot or Reg # | Description | Linker / Ab Site |
|---|---|---|
| PL-42834 | GLP1 (A2G/R30G)-1Kmod 6H1(HC) | 1Kmod - 6H1-HC |
| PL-45560 | GLP1 (A2S/R30G)-1Kmod 6H1(HC) | 1Kmod - 6H1-HC |
| PL-45561 | GLP1 (A2G/E3Q/R30G)-1Kmod 6H1(HC) | 1Kmod - 6H1-HC |
| PL-45570 | GLP1 (A2G/E3D/R30G)-1Kmod 6H1(HC) | 1Kmod - 6H1-HC |
| PL-45571 | GLP1 (A2S/E3D/R30G)-1Kmod 6H1(HC) | 1Kmod - 6H1-HC |

| LMR | $C_0$ (μg/mL) | $AUC_{0\text{-}inf}$ (hr*μg/mL) | CL (mL/hr/kg) | $T_{1/2,terminal}$ (day) |
|---|---|---|---|---|
| PL-42834 | 75.5 | 1800 | 2.78 | 1.18 |
| PL-45560 | 92.0 | 1990 | 2.52 | 1.30 |
| PL-45561 | 90.3 | 1770 | 2.82 | 0.78 |
| PL-45570 | 106 | 2150 | 2.33 | 1.02 |
| PL-45571 | 110 | 2320 | 2.15 | 0.98 |

| LMR | $C_0$ (µg/mL) | $AUC_{0\text{-}inf}$ (hr*µg/mL) | CL (mL/hr/kg) | $T_{1/2,terminal}$ (day) |
|---|---|---|---|---|
| PL-42834 | 78.7 | 3970 | 1.26 | 2.45 |
| PL-45560 | 94.9 | 4210 | 1.19 | 2.32 |
| PL-45561 | 87.2 | 3780 | 1.32 | 2.16 |
| PL-45570 | 99.4 | 4330 | 1.15 | 2.61 |
| PL-45571 | 107 | 5030 | 0.99 | 2.37 |

| | |
|---|---|
| PL-42834 | GLP1(A2G/R30G)-1Kmod 6H1(HC) |
| PL-45560 | GLP1(A2S/R30G)-1Kmod 6H1(HC) |
| PL-45561 | GLP1(A2G/E3Q/R30G)-1Kmod 6H1(HC) |
| PL-45570 | GLP1(A2G/E3D/R30G)-1Kmod 6H1(HC) |
| PL-45571 | GLP1(A2S/E3D/R30G)-1Kmod 6H1(HC) |

Ab: 6H1 HC

GLP1 Analogue: A2G/R30G

Linkers

- Null
- $G_4$
- $G_4SG_4$
- $(G_4A)_2G_4$
- $(G_4A)_3G_4$
- $G(AP)_4G$
- $G(AP)_6G$
- $G(AP)_8G$
- $G(AP)_{10}G$ α -GIPR mAb
6H1-HC

FIG. 9

| Construct | Lot | GLP1 $EC_{50}$ (pM) | GIPR $IC_{50}$ (nM) | Yield (g/L) | SEC (%MP) | Note |
|---|---|---|---|---|---|---|
| No Linker | N/A | N/A | N/A | N/A | N/A | No Express |
| G4 | PL-45578 | 44 | 183 | 89 | 100 | Irreg. SEC |
| G4SG4 | PL-45579 | 39 | 822 | 161 | 100 | Irreg. SEC |
| (G4A)2G4 | PL-45580 | 29 | 351 | 150 | 99 | Irreg. SEC |
| → (G4A)3G4 | PL-45576 | 40 | 536 | 47 | 99 | |
| G(AP)6G | PL-45581 | 27 | 292 | 195 | 99 | |
| G(AP)8G | PL-45582 | 31 | 504 | 210 | 99 | |
| → G(AP)10G | PL-45583 | 23 | 198 | 163 | 99 | |

Selected linkers

- 1Kmod {GSGSATGGSGSVASSGSGSATHL} [23AA]
- $(G_4A)_3G_4$ [19AA]
- $G(AP)_{10}G$ [22AA]

REQ-53452

| | | |
|---|---|---|
| 53452 | GLP1 (A2G/R30G)-G(AP)6G-6H1(HC) | G(AP)6G - 6H1-HC |
| 53452 | GLP1 (A2G/R30G)-G(AP)10G-6H1(HC) | G(AP)10G - 6H1-HC |
| 52512 | GLP1 (A2G/R30G)-1Kmod 6H1(HC) | 1Kmod - 6H1-HC |
| 53452 | GLP1(A2G/R30G)-(G4A)3G4 -6H1(HC) | (G4A)3G4 -6H1(HC) |
| 53452 | GLP1 (A2G/R30G)-G(AP)6G-6H1(HC) | G(AP)6G - 6H1-HC |
| 53452 | GLP1 (A2G/R30G)-G(AP)10G-6H1(HC) | G(AP)10G - 6H1-HC |

FIG. 11A
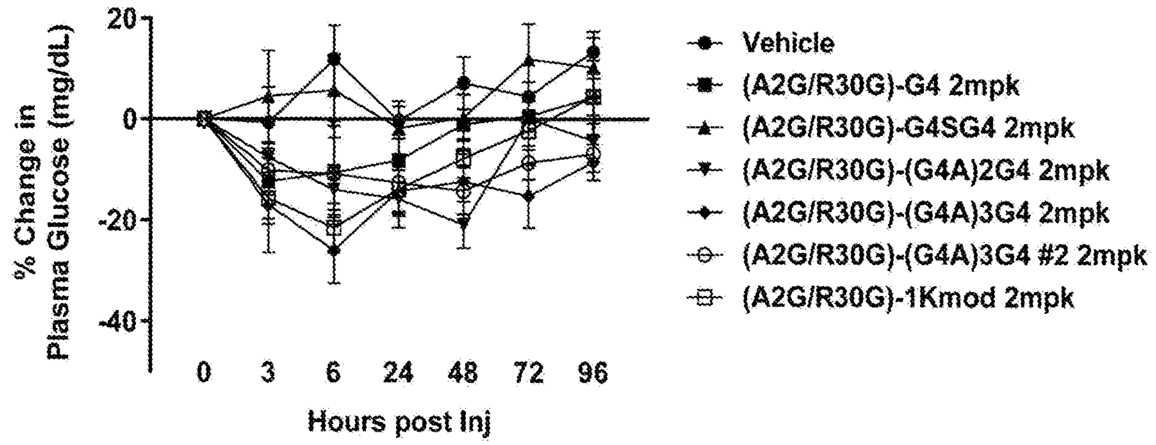
FIG. 11B
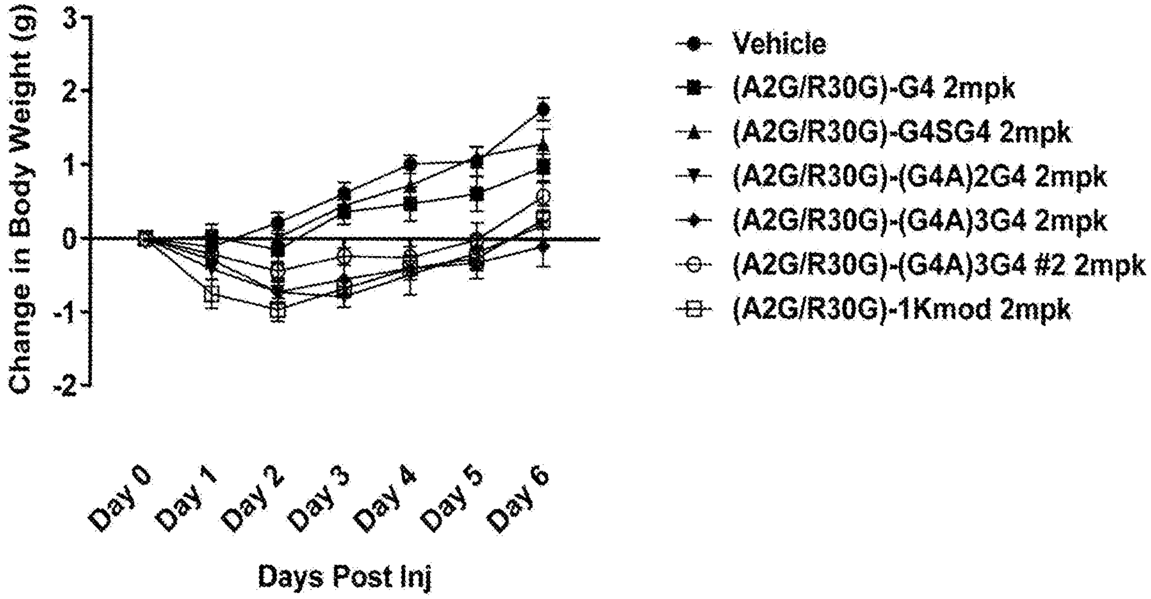
FIG. 11C
| Biologic Lot or Reg # | Description | Linker / Ab Site |
|---|---|---|
| PL-45577 | GLP1(A2G/R30G)-(G4A)3G4 #2-6H1(HC) | (G4A)3G4 #2-6H1(HC) |
| PL-45578 | GLP1(A2G/R30G)-G4-6H1(HC) | G4-6H1(HC) |
| PL-45579 | GLP1(A2G/R30G)-G4SG4-6H1(HC) | G4SG4-6H1(HC) |
| PL-45580 | GLP1(A2G/R30G)-(G4A)2G4-6H1(HC) | (G4A)2G4-6H1(HC) |
| PL-42834 | GLP1 (A2G/R30G)-1Kmod 6H1(HC) | 1Kmod - 6H1-HC |
| PL-45576 | GLP1(A2G/R30G)-(G4A)3G4 -6H1(HC) | (G4A)3G4 -6H1(HC) |

| LMR | $C_0$ (µg/mL) | $AUC_{0\text{-inf}}$ (hr*µg/mL) | CL (mL/hr/kg) | $T_{1/2,\text{terminal}}$ (day) |
|---|---|---|---|---|
| PL-45576 | 90.5 | 2320 | 2.15 | 1.29 |
| PL-45581 | 89.3 | 1990 | 2.52 | 0.89 |
| PL-45582 | 96.2 | 1840 | 2.72 | 0.66 |
| PL-45583 | 89.5 | 1600 | 3.13 | 0.60 |

| LMR | $C_0$ (µg/mL) | $AUC_{0\text{-inf}}$ (hr*µg/mL) | CL (mL/hr/kg) | $T_{1/2,terminal}$ (day) |
|---|---|---|---|---|
| PL-45576 | 88.8 | 4520 | 1.11 | 2.57 |
| PL-45581 | 92.2 | 3960 | 1.26 | 1.87 |
| PL-45582 | 97.8 | 4050 | 1.23 | 1.76 |
| PL-45583 | 86.1 | 3730 | 1.34 | 2.02 |

| | |
|---|---|
| PL-45576 | GLP1(A2G/R30G)-(G4A)3G4-6H1(HC) |
| PL-45581 | GLP1(A2G/R30G)-G(AP)6G-6H1(HC) |
| PL-45582 | GLP1(A2G/R30G)-G(AP)8G-6H1(HC) |
| PL-45583 | GLP1(A2G/R30G)-G(AP)10G-6H1(HC) |

FIG. 13

Ab: 6H1 HC

N-terminal substitutions (5):
A2G, A2S, A2S / E3Q, A2G / E3D, A2S / E3D

C-terminal region substitutions (4):
WT (AWLVK)
A24E (Single)
V27K/K28N (Double)
A24E/V27K/K28N (Triple)

Linkers (3):
1Kmod
(G4A)3G4
G(AP)10G

FIG. 14

| | | | | GIPR Activity | | GLP-1 Activity | |
|---|---|---|---|---|---|---|---|
| ID | N-term mod | C-term mod | Linker | IC50 M | IC50 nM | EC50 M | EC50 pM |
| 6H1.004 | control | | | 2.14E-08 | 21.4 | | |
| 6H1.004 | control | | | 2.95E-08 | 29.5 | | |
| 6H1.004 | control | | | 3.52E-08 | 35.2 | | |
| GLP-1 | control | | | | | 1.6E-12 | 1.6 |
| GLP-1 | control | | | | | 2.85E-12 | 2.8 |
| GLP-1 | control | | | | | 1.74E-12 | 1.7 |
| PL-47367 | A2G | WT C-term | 1Kmod | 2.44E-07 | 244 | 1.79E-11 | 17.8 |
| PL-47368 | A2S | WT C-term | 1Kmod | 3.51E-07 | 351 | 1.71E-11 | 17.1 |
| PL-47369 | A2S/E3Q | WT C-term | 1Kmod | 4.14E-08 | 41.1 | 2.79E-12 | 2.8 |
| PL-47370 | A2G/E3D | WT C-term | 1Kmod | 1.97E-07 | 197 | 1.11E-11 | 11.1 |
| PL-47371 | A2S/E3D | WT C-term | 1Kmod | 4.24E-07 | 424 | 1.62E-11 | 16.2 |
| PL-47372 | A2G | A24E | 1Kmod | 3.98E-08 | 39.8 | 4.46E-12 | 4.5 |
| PL-47373 | A2S | A24E | 1Kmod | 3.24E-07 | 324 | 1.63E-11 | 16.3 |
| PL-47374 | A2S/E3Q | A24E | 1Kmod | 5.35E-07 | 535 | 1.23E-11 | 12.3 |
| PL-47375 | A2G/E3D | A24E | 1Kmod | 4.88E-07 | 488 | 1.69E-11 | 16.9 |
| PL-47376 | A2S/E3D | A24E | 1Kmod | 1.98E-06 | 1980 | 5.04E-12 | 5 |
| PL-47377 | A2G | V27K/K28N | 1Kmod | 1.29E-07 | 129 | 1.97E-11 | 19.7 |
| PL-47378 | A2S | V27K/K28N | 1Kmod | 1.33E-07 | 133 | 1.58E-11 | 15.8 |
| PL-47379 | A2S/E3Q | V27K/K28N | 1Kmod | 1.49E-07 | 149 | 2.15E-11 | 21.5 |
| PL-47380 | A2G/E3D | V27K/K28N | 1Kmod | 1.29E-07 | 129 | 1.49E-11 | 14.9 |
| PL-47381 | A2S/E3D | V27K/K28N | 1Kmod | 1.41E-07 | 141 | 2.9E-11 | 28.9 |
| PL-47382 | A2G | A24E/V27K/K28N | 1Kmod | 1.58E-07 | 158 | 1.91E-11 | 19.1 |
| PL-47383 | A2S | A24E/V27K/K28N | 1Kmod | 1.62E-07 | 162 | 1.08E-11 | 10.8 |
| PL-47384 | A2S/E3Q | A24E/V27K/K28N | 1Kmod | 1.49E-07 | 149 | 1.75E-11 | 17.5 |
| PL-47385 | A2G/E3D | A24E/V27K/K28N | 1Kmod | 1.85E-07 | 185 | 3.53E-11 | 35.3 |
| PL-47386 | A2S/E3D | A24E/V27K/K28N | 1Kmod | 2.30E-07 | 230 | 1.1E-11 | 10.9 |

FIG. 15

| | | | | GIPR Activity | | GLP-1 Activity | |
|---|---|---|---|---|---|---|---|
| ID | N-term mod | C-term mod | Linker | IC50 M | IC50 nM | EC50 M | EC50 pM |
| 6H1.004 | control | | | 2.14E-08 | 21.4 | | |
| 6H1.004 | control | | | 2.95E-08 | 29.5 | | |
| 6H1.004 | control | | | 3.52E-08 | 35.2 | | |
| GLP-1 | control | | | | | 1.6E-12 | 1.6 |
| GLP-1 | control | | | | | 2.85E-12 | 2.8 |
| GLP-1 | control | | | | | 1.74E-12 | 1.7 |
| PL-47387 | A2G | WT C-term | (G4A)3G4 | 1.71E-07 | 171 | 4.39E-11 | 43.9 |
| PL-47388 | A2S | WT C-term | (G4A)3G4 | 1.91E-07 | 191 | 3.16E-11 | 31.6 |
| PL-47389 | A2S/E3Q | WT C-term | (G4A)3G4 | 3.42E-07 | 342 | 3.48E-11 | 34.8 |
| PL-47390 | A2G/E3D | WT C-term | (G4A)3G4 | 2.25E-07 | 225 | 1.59E-11 | 15.8 |
| PL-47391 | A2S/E3D | WT C-term | (G4A)3G4 | 4.07E-07 | 407 | 1.55E-11 | 15.5 |
| PL-47392 | A2G | A24E | (G4A)3G4 | 3.42E-07 | 342 | 1.39E-11 | 13.9 |
| PL-47393 | A2S | A24E | (G4A)3G4 | 2.03E-07 | 203 | 1.22E-11 | 12.2 |
| PL-47394 | A2S/E3Q | A24E | (G4A)3G4 | 3.20E-07 | 320 | 1.54E-11 | 15.4 |
| PL-47395 | A2G/E3D | A24E | (G4A)3G4 | 2.55E-07 | 255 | 1.39E-11 | 13.9 |
| PL-47396 | A2S/E3D | A24E | (G4A)3G4 | 1.21E-06 | 1210 | 1.51E-11 | 15.1 |
| PL-47397 | A2G | V27K/K28N | (G4A)3G4 | 1.78E-07 | 178 | 3.59E-11 | 35.9 |
| PL-47398 | A2S | V27K/K28N | (G4A)3G4 | 1.69E-07 | 169 | 4.17E-11 | 41.7 |
| PL-47399 | A2S/E3Q | V27K/K28N | (G4A)3G4 | 1.19E-07 | 119 | 2.75E-11 | 27.5 |
| PL-47400 | A2G/E3D | V27K/K28N | (G4A)3G4 | 1.73E-07 | 173 | 2.43E-11 | 24.3 |
| PL-47401 | A2S/E3D | V27K/K28N | (G4A)3G4 | 1.82E-07 | 182 | 2.71E-11 | 27.1 |
| PL-47402 | A2G | A24E/V27K/K28N | (G4A)3G4 | 1.45E-07 | 145 | 1.87E-11 | 18.7 |
| PL-47403 | A2S | A24E/V27K/K28N | (G4A)3G4 | 1.97E-07 | 197 | 1.12E-11 | 11.2 |
| PL-47404 | A2S/E3Q | A24E/V27K/K28N | (G4A)3G4 | 1.65E-07 | 165 | 2.32E-11 | 23.2 |
| PL-47405 | A2G/E3D | A24E/V27K/K28N | (G4A)3G4 | 1.42E-07 | 142 | 2.11E-11 | 21.1 |
| PL-47406 | A2S/E3D | A24E/V27K/K28N | (G4A)3G4 | 1.81E-07 | 181 | 3.72E-11 | 37.2 |

FIG. 16

| | | | | GIPR Activity | | GLP-1 Activity | |
|---|---|---|---|---|---|---|---|
| ID | N-term mod | C-term mod | Linker | IC50 M | IC50 nM | EC50 M | EC50 pM |
| 6H1.004 | control | | | 2.14E-08 | 21.4 | | |
| 6H1.004 | control | | | 2.95E-08 | 29.5 | | |
| 6H1.004 | control | | | 3.52E-08 | 35.2 | | |
| GLP-1 | control | | | | | 1.6E-12 | 1.6 |
| GLP-1 | control | | | | | 2.85E-12 | 2.8 |
| GLP-1 | control | | | | | 1.74E-12 | 1.7 |
| PL-47407 | A2G | WT C-term | G(AP)10G | 1.29E-07 | 129 | 3.65E-12 | 3.6 |
| PL-47408 | A2S | WT C-term | G(AP)10G | 1.02E-07 | 102 | 3.59E-12 | 3.6 |
| PL-47409 | A2S/E3Q | WT C-term | G(AP)10G | 1.11E-07 | 111 | 5.54E-12 | 5.5 |
| PL-47410 | A2G/E3D | WT C-term | G(AP)10G | 1.51E-07 | 151 | 4.65E-12 | 4.6 |
| PL-47411 | A2S/E3D | WT C-term | G(AP)10G | 3.88E-07 | 388 | 3.78E-12 | 3.8 |
| PL-47412 | A2G | A24E | G(AP)10G | 1.62E-07 | 162 | 5.22E-12 | 5.2 |
| PL-47413 | A2S | A24E | G(AP)10G | 6.81E-06 | 6810 | 2.99E-12 | 2.9 |
| PL-47414 | A2S/E3Q | A24E | G(AP)10G | 1.10E-07 | 110 | 5.53E-12 | 5.5 |
| PL-47415 | A2G/E3D | A24E | G(AP)10G | 1.53E-07 | 153 | 3.81E-12 | 3.8 |
| PL-47416 | A2S/E3D | A24E | G(AP)10G | 2.52E-06 | 2520 | 5.52E-12 | 5.5 |
| PL-47417 | A2G | V27K/K28N | G(AP)10G | 6.59E-08 | 65.9 | 5.52E-12 | 5.5 |
| PL-47418 | A2S | V27K/K28N | G(AP)10G | 5.35E-08 | 53.5 | 5.17E-12 | 5.2 |
| PL-47419 | A2S/E3Q | V27K/K28N | G(AP)10G | 7.32E-08 | 73.2 | 8.52E-12 | 8.5 |
| PL-47420 | A2G/E3D | V27K/K28N | G(AP)10G | 8.66E-08 | 86.7 | 4.66E-12 | 4.7 |
| PL-47421 | A2S/E3D | V27K/K28N | G(AP)10G | 1.08E-07 | 108 | 3.17E-12 | 3.2 |
| PL-47422 | A2G | A24E/V27K/K28N | G(AP)10G | 6.55E-08 | 65.5 | 2.95E-12 | 2.9 |
| PL-47423 | A2S | A24E/V27K/K28N | G(AP)10G | 2.52E-08 | 25.1 | 6.21E-12 | 6.2 |
| PL-47424 | A2S/E3Q | A24E/V27K/K28N | G(AP)10G | 7.33E-08 | 73.3 | 3.77E-12 | 3.7 |
| PL-47425 | A2G/E3D | A24E/V27K/K28N | G(AP)10G | 6.03E-08 | 60.3 | 2.52E-12 | 2.5 |
| PL-47426 | A2S/E3D | A24E/V27K/K28N | G(AP)10G | 2.4E-07 | 239 | 3.2E-12 | 3.2 |

FIG. 17

Aggregate of Varied C-term and Linkers

| Construct | GLP1 $EC_{50}$ Avg (pM) | GIPR $IC_{50}$ Avg (nM) |
|---|---|---|
| (A2G/G16E/R30G) | 16 ± 4 | 152 ± 24 |
| (A2G/E3D/G16E/R30G) | 14 ± 3 | 176 ± 35 |
| (A2S/G16E/R30G) | 15 ± 3 | 174 ± 30 |
| (A2S/E3D/G16E/R30G) | 14 ± 3 | 499 ± 174 |
| (A2S/E3Q/G16E/R30G) | 15 ± 3 | 182 ± 42 |

Wild type GLP1 C-term (AWLVK)
- A24E
- V27K/K28N
- A24E/V27K/K28N

Linkers
- 1Kmod {GSGSATGGSGSVASSGSGSATHL}
- (G4A)3G4
- G(AP)10G

FIG. 18

VCA / HGE 95% Probability
Expected Cleavage

SignalP NN for Vh5a: huGLP-1 (A2G,R30G):(hu anti-<huGIPR> 21-143_6H1 VH): huIgG1zSEFL2

VCA / HSE 98% Probability
Expected Cleavage

SignalP NN for VH5a: huGLP-1 (A2S,R30G):(hu anti-<huGIPR> 21-143_6H1 VH): huIgG1zSEFL2

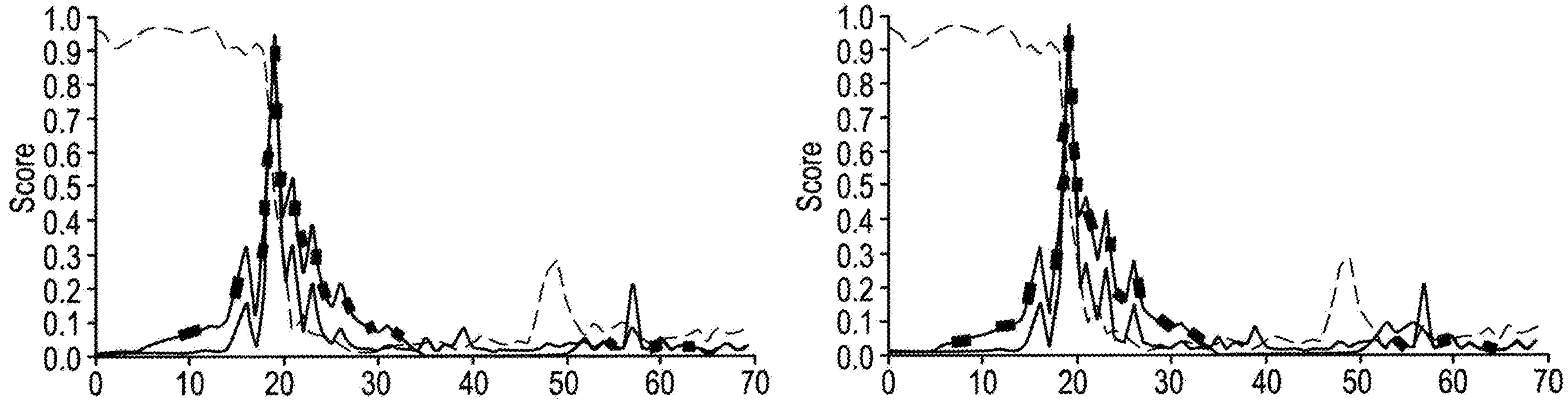

Output from the SignalP 4.0 web-server for the GLP1-GIPR sequence. 'C-score' (——) is the predicted cleavage site value, 'S-score' is the predicted signal peptide value (— —) and 'Y-score' (▪▪▪) is a combination of C-and S-scores.

FIG. 19

Aggregate of Varied N-term and Linkers

| Construct | GLP1 $EC_{50}$ Avg (pM) | GIPR $IC_{50}$ Avg (nM) |
|---|---|---|
| WT (AWLVK) | 15 ± 3 | 223 ± 34 |
| A24E | 10 ± 1 | 471 ± 150 |
| V27K/K28N | 19 ± 3 | 126 ± 11 |
| A24E/V27K/K28N | 15 ± 3 | 145 ± 16 |

N-termini
- A2G/G16E/R30G
- A2S/G16E/R30G
- A2S/E3Q/G16E/R30G
- A2G/ E3D/G16E/R30G
- A2S/E3D/G16E/R30G Linkers
- 1Kmod {GSGSATGGSGSVASSGSGSATHL}
- (G4A)3G4
- G(AP)10G

| LMR | GLP1 sequence modification | $C_0$ (μg/mL) | $AUC_{0\text{-}inf}$ (hr*μg/mL) | CL (mL/hr/kg) | $T_{1/2,terminal}$ (hr) |
|---|---|---|---|---|---|
| PL-47367 | A2G/G16E/R30G | 76.7 | 1680 | 2.98 | 23.8 |
| PL-47372 | A2G/G16E/A24E/R30G | 88.2 | 2310 | 2.17 | 36.5 |
| PL-47377 | A2G/G16E/V27K/K28N/R30G | 86.7 | 1800 | 2.78 | 22.0 |
| PL-47382 | A2G/G16E/A24E/V27K/K28N/R30G | 75.6 | 2080 | 2.41 | 28.0 |

| LMR | GLP1 sequence modification | $C_0$ (μg/mL) | $AUC_{0\text{-}inf}$ (hr*μg/mL) | CL (mL/hr/kg) | $T_{1/2,terminal}$ (hr) |
|---|---|---|---|---|---|
| PL-47367 | A2G/G16E/R30G | 73.8 | 3170 | 1.58 | 41.9 |
| PL-47372 | A2G/G16E/A24E/R30G | 91.4 | 4390 | 1.14 | 65.2 |
| PL-47377 | A2G/G16E/V27K/K28N/R30G | 81.1 | 3300 | 1.52 | 46.1 |
| PL-47382 | A2G/G16E/A24E/V27K/K28N/R30G | 74.8 | 3650 | 1.37 | 51.3 |

| LMR | GLP1 sequence modification | $C_0$ (μg/mL) | $AUC_{0\text{-}inf}$ (hr*μg/mL) | CL (mL/hr/kg) | $T_{1/2,terminal}$ (hr) |
|---|---|---|---|---|---|
| PL-47387 | A2G/G16E/R30G | 77.4 | 1740 | 2.87 | 30.1 |
| PL-47392 | A2G/G16E/A24E/R30G | 75.5 | 2370 | 2.11 | 42.0 |
| PL-47397 | A2G/G16E/V27K/K28N/R30G | 85.5 | 2010 | 2.49 | 30.3 |
| PL-47402 | A2G/G16E/A24E/V27K/K28N/R30G | 83.1 | 2500 | 2.00 | 36.0 |

| LMR | GLP1 sequence modification | $C_0$ (µg/mL) | $AUC_{0\text{-inf}}$ (hr*µg/mL) | CL (mL/hr/kg) | $T_{1/2,terminal}$ (hr) |
|---|---|---|---|---|---|
| PL-47387 | A2G/G16E/R30G | 72.6 | 3240 | 1.54 | 63.7 |
| PL-47392 | A2G/G16E/A24E/R30G | 75.8 | 4380 | 1.14 | 81.2 |
| PL-47397 | A2G/G16E/V27K/K28N/R30G | 88.2 | 3840 | 1.30 | 65.4 |
| PL-47402 | A2G/G16E/A24E/V27K/K28N/R30G | 87.2 | 4510 | 1.11 | 69.6 |

| LMR | GLP1 sequence modification | $C_0$ (μg/mL) | $AUC_{0\text{-}inf}$ (hr*μg/mL) | CL (mL/hr/kg) | $T_{1/2,terminal}$ (hr) |
|---|---|---|---|---|---|
| PL-47417 | A2G/G16E/V27K/K28N/R30G | 79.4 | 1440 | 3.48 | 13.5 |
| PL-47422 | A2G/G16E/A24E/V27K/K28N/R30G | 74.3 | 1600 | 3.12 | 21.8 |

| LMR | GLP1 sequence modification | $C_0$ (μg/mL) | $AUC_{0\text{-}inf}$ (hr*μg/mL) | CL (mL/hr/kg) | $T_{1/2,terminal}$ (hr) |
|---|---|---|---|---|---|
| PL-47417 | A2G/G16E/V27K/K28N/R30G | 80.6 | 3450 | 1.45 | 49.5 |
| PL-47422 | A2G/G16E/A24E/V27K/K28N/R30G | 73.8 | 3220 | 1.55 | 53.1 |

FIG. 23

Aggregate of Varied C-term and Linkers

| Construct | GLP1 $EC_{50}$ Avg (pM) | GIPR $IC_{50}$ Avg (nM) |
|---|---|---|
| 1Kmod | 16 ± 2 | 309 ± 93 |
| (G4A)3G4 | 24 ± 2 | 266 ± 53 |
| G(AP)10G | 4 ± 0 | 112 ± 20 |

N-termini
- A2G/G16E/R30G
- A2S/G16E/R30G
- A2S/E3Q/G16E/R30G
- A2G/ E3D/G16E/R30G
- A2S/E3D/G16E/R30G Wild type GLP1 C-term (AWLVK)
- A24E
- V27K/K28N
- A24E/V27K/K28N

| LMR | Linker | $C_0$ (µg/mL) | $AUC_{0\text{-}inf}$ (hr*µg/mL) | CL (mL/hr/kg) | $T_{1/2,terminal}$ (hr) |
|---|---|---|---|---|---|
| PL-47382 | 1Kmod | 75.6 | 2080 | 2.41 | 28.0 |
| PL-47402 | (G4A)3G4 | 83.1 | 2500 | 2.00 | 36.0 |
| PL-47422 | G(AP)10G | 74.3 | 1600 | 3.12 | 21.8 |

| LMR | Linker | $C_0$ (µg/mL) | $AUC_{0\text{-}inf}$ (hr*µg/mL) | CL (mL/hr/kg) | $T_{1/2,terminal}$ (hr) |
|---|---|---|---|---|---|
| PL-47382 | 1Kmod | 74.8 | 3650 | 1.37 | 51.3 |
| PL-47402 | (G4A)3G4 | 87.2 | 4510 | 1.11 | 69.6 |
| PL-47422 | G(AP)10G | 73.8 | 3220 | 1.55 | 53.1 |

FIG. 25

Ab: 2G10 HC & LC

Linkers: 1Kmod, (G4A)3G4 and G(AP)10G

GLP1(A2G/G16E/A24E/V27K/K28N/R30G) Triple
GLP1(7-22/A2G)Ex4(17-39) hybrid

FIG. 26

Mouse pk study

- Purpose
  - Evaluate the single dose pharmacokinetics of 4 GIPR-GLP1 recombinant fusions in mice
- Constructs
  - GLP1 analog: A2G/G16E/A24E/V27K/K28N/R30G
  - Linkers: 1Kmod or G4A
  - Fusion to heavy chain (HC) or light chain (LC) of 2G10

| LMR | Description |
|---|---|
| PL-50123 | GLP1(Ana)-1K-αhuGIPR(2G10) HC |
| PL-50124 | GLP1(Ana)-G4A-αhuGIPR(2G10) HC |
| PL-50125 | GLP1(Ana)-1K-αhuGIPR(2G10) LC |
| PL-50126 | GLP1(Ana)-G4A-αhuGIPR(2G10) LC |

- Study design
  - Each construct administered as 5 mg/kg IV bolus to CD-1 mice (n=3 per group)
  - Plasma collected at 0.083, 24, 48, 96, 168, 240, and 336 hr post-dose for PK bioanalysis by intact and total assay

| LMR | $C_0$ (μg/mL) | $AUC_{0-t}$ (hr*μg/mL) | $CL_{0-t}$ (mL/hr/kg) | $T_{1/2,terminal}$ (hr) |
|---|---|---|---|---|
| PL-50123 | 80.8 | 3680 | 1.36 | 74.3 |
| PL-50124 | 76.4 | 2910 | 1.72 | 69.4 |
| PL-50125 | 83.6 | 3760 | 1.33 | 64.3 |
| PL-50126 | 89.2 | 3980 | 1.26 | 75.4 |

| LMR | $C_0$ (µg/mL) | $AUC_{0-t}$ (hr*µg/mL) | $CL_{0-t}$ (mL/hr/kg) | $T_{1/2,terminal}$ (hr) |
|---|---|---|---|---|
| PL-50123 | 83.3 | 9450 | 0.529 | *n/a |
| PL-50124 | 77.9 | 8910 | 0.561 | n/a |
| PL-50125 | 78.3 | 8860 | 0.564 | n/a |
| PL-50126 | 85.2 | 9230 | 0.542 | n/a |

*Terminal slope insufficient for accurate half-life determination

FIG. 28

Ab: 2G10 HC & LC

Linkers: 1Kmod & (G4A)3G4

GLP1(A2G/G16E/A24E/V27K/K28N/R30G) Triple (Ana)
GLP1(A2G/G16E/A24E/R30G) Single (Ana1)

FIG. 29

| Construct | PL | GIPR $IC_{50}$ (nM) | GLP1 $EC_{50}$ (pM) | GLP1 $EC_{50}$ (pM) | Avg GLP1 (pM) |
|---|---|---|---|---|---|
| Triple-1K-HC | 51747 | 73.6 | 17.2 | 9.9 | 13.6 |
| Triple-G4A-HC | 51748 | 73.6 | 15.9 | 18.0 | 17.0 |
| Triple-1K-LC | 51749 | 60.8 | 12.3 | 10.8 | 11.6 |
| Triple-G4A-LC | 51750 | 44.9 | 8.9 | 14.5 | 11.7 |
| Single-1K-HC | 51752 | 50.7 | 11.2 | 15.3 | 13.3 |
| Single-G4A-HC | 51751 | 49.2 | 12.1 | 19.7 | 15.9 |
| Single-1K-LC | 51754 | 65.4 | 15.7 | 13.5 | 14.6 |
| Single-G4A-LC | 51757 | 30.6 | 9.8 | 9.7 | 9.8 |

FIG. 30

Mouse pk study

- Purpose
  - Evaluate the single dose pharmacokinetics of 4 GIPR-GLP1 recombinant fusions in mice
- Constructs
  - GLP1 analog: A2G/G16E/A24E/R30G
  - Linkers: 1Kmod or G4A
  - Fusion to heavy chain (HC) or light chain (LC) of 2G10

| LMR | Description |
|---|---|
| PL-51409 | GLP1(Ana)-1K-αhuGIPR(2G10) HC |
| PL-51408 | GLP1(Ana)-G4A-αhuGIPR(2G10) HC |
| PL-51406 | GLP1(Ana)-1K-αhuGIPR(2G10) LC |
| PL-51407 | GLP1(Ana)-G4A-αhuGIPR(2G10) LC |

- Study design
  - Each construct administered as 5 mg/kg IV bolus to CD-1 mice (n=3 per group)
  - Plasma collected at 0.083, 24, 48, 96, 168, 240, and 336 hr post-dose for PK bioanalysis by intact and total assay

| LMR | $C_0$ (µg/mL) | $AUC_{0-t}$ (hr*µg/mL) | $CL_{0-t}$ (mL/hr/kg) | $T_{1/2,terminal}$ (hr) |
|---|---|---|---|---|
| PL-51409 | 91.6 | 2860 | 1.75 | 70.0 |
| PL-51408 | 98.3 | 2660 | 1.88 | 47.7 |
| PL-51406 | 78.7 | 2600 | 1.92 | 57.9 |
| PL-51407 | 81.1 | 2980 | 1.68 | 68.8 |

| LMR | $C_0$ (μg/mL) | $AUC_{0\text{-}t}$ (hr*μg/mL) | $CL_{0\text{-}t}$ (mL/hr/kg) | $T_{1/2,terminal}$ (hr) |
|---|---|---|---|---|
| PL-51409 | 100 | 10900 | 0.459 | *n/a |
| PL-51408 | 104 | 10200 | 0.490 | n/a |
| PL-51406 | 85.5 | 8740 | 0.572 | n/a |
| PL-51407 | 83.5 | 8450 | 0.592 | n/a |

*Terminal slope insufficient for accurate half-life determination

| Biologic Lot or Reg # | REQ | Description | Linker / Ab Site |
|---|---|---|---|
| PL-51747 | 54630 | GLP1(A2G, G16E, A24E, V27K, K28N, R30G)-1Kmod-HC 2G10 | 1Kmod - 2G10-HC |
| PL-51748 | 54630 | GLP1(A2G, G16E, A24E, V27K, K28N, R30G)-(G4A)3G4-HC 2G10 | (G4A)3G4 - 2G10-HC |
| PL-51749 | 54630 | GLP1(A2G, G16E, A24E, V27K, K28N, R30G)-1Kmod-LC 2G10 | 1Kmod - 2G10-LC |
| PL-51752 | 54630 | GLP1(A2G, G16E, A24E, R30G)-1Kmod-HC 2G10 | 1Kmod - 2G10-HC |
| PL-51754 | 54322 | GLP1(A2G, G16E, A24E, R30G)-1Kmod-LC 2G10 | 1Kmod - 2G10-LC |
| PL-51750 | 54630 | GLP1(A2G, G16E, A24E, V27K, K28N, R30G)-(G4A)3G4-LC 2G10 | (G4A)3G4 - 2G10-LC |

| Biologic Lot or Reg # | REQ | Description | Linker / Ab Site |
|---|---|---|---|
| PL-51750 | 54630 | GLP1(A2G, G16E, A24E, V27K, K28N, R30G)-(G4A)3G4-LC 2G10 | (G4A)3G4 - 2G10-LC |
| PL-51751 | 54630 | GLP1(A2G, G16E, A24E, R30G)-(G4A)3G4-HC 2G10 | (G4A)3G4 - 2G10-HC |
| PL-51757 | 54322 | GLP1(A2G, G16E, A24E, R30G)-(G4A)3G4-LC 2G10 | (G4A)3G4 - 2G10-LC |

| Biologic Lot or Reg # | REQ | Description | Linker / Ab Site |
|---|---|---|---|
| 2419-1 | | GLP1(A2G, G16E, A24E, V27K, K28N, R30G)-1Kmod-LC 5G12 | 1Kmod - 5G12-LC |
| 2420-1 | | GLP1(A2G, G16E, A24E, V27K, K28N, R30G)-(G4A)3G4-HC 5G12 | (G4A)3G4 - 5G12-HC |
| 2421-1 | | GLP1(A2G, G16E, A24E, V27K, K28N, R30G)-(G4A)3G4-LC 5G12 | (G4A)3G4 - 5G12-LC |
| 2422-1 | | GLP1(A2G, G16E, A24E, V27K, K28N, R30G)-1Kmod-HC 5G12 | 1Kmod - 5G12-HC |
| PL-51750 | | GLP1(A2G, G16E, A24E, V27K, K28N, R30G)-(G4A)3G4-LC 2G10 | (G4A)3G4 - 2G10-LC |

| BioReg | $C_0$ (μg/mL) | $AUC_{0\text{-}t}$ (hr*μg/mL) | $CL_{0\text{-}t}$ (mL/hr/kg) | $T_{1/2,terminal}$ (hr) |
|---|---|---|---|---|
| 2419-1 | 95.6 | 3660 | 1.37 | 55.9 |
| 2420-1 | 99.0 | 2560 | 1.95 | 46.4 |
| 2421-1 | 90.6 | 3380 | 1.48 | 58.0 |
| 2422-1 | 93.4 | 2490 | 2.01 | 37.2 |

| BioReg | $C_0$ (μg/mL) | $AUC_{0-t}$ (hr*μg/mL) | $CL_{0-t}$ (mL/hr/kg) | $T_{1/2,terminal}$ (hr) |
|---|---|---|---|---|
| 2419-1 | 97.2 | 6710 | 0.745 | *n/a |
| 2420-1 | 98.8 | 5570 | 0.898 | n/a |
| 2421-1 | 95.3 | 5790 | 0.864 | n/a |
| 2422-1 | 91.1 | 5230 | 0.956 | n/a |

*Terminal slope insufficient for accurate half-life determination

METHOD OF TREATING OR AMELIORATING METABOLIC DISORDERS USING ANTAGONISTIC BINDING PROTEINS FOR GASTRIC INHIBITORY PEPTIDE RECEPTOR (GIPR)/GLP-1 RECEPTOR AGONIST FUSION PROTEINS

CROSS REFERENCE TO RELATED APPLICATIONS

This application is a national stage application under 35 U.S.C. § 371 of International Application No. PCT/US2018/038634, having an international filing date of 20 Jun. 2018, which claims the benefit of U.S. Provisional Patent Application No. 62/523,216, filed 21 Jun. 2017, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jul. 21, 2022, is named A-2165-US-PCT_SL.txt and is 4,462,762 bytes in size.

FIELD OF THE INVENTION

The present disclosure relates to the treatment or amelioration of a metabolic disorder, such as type 2 diabetes, elevated glucose levels, elevated insulin levels, obesity, non-alcoholic fatty liver disease, cardiovascular diseases or diabetic nephropathy, using GLP-1 receptor agonists fused via a peptide linker to an antigen binding protein specific for the gastric inhibitory peptide receptor (GIPR).

BACKGROUND OF THE INVENTION

Glucose-dependent insulinotropic polypeptide (GIP) is a single 42-amino acid peptide secreted from K-cells in the small intestine (duodenum and jejunum). Human GIP is derived from the processing of proGIP, a 153-amino acid precursor that is encoded by a gene localized to chromosome 17q (Inagaki et al., Mol Endocrinol 1989; 3:1014-1021; Fehmann et al. Endocr Rev. 1995; 16:390-410). GIP was formerly called gastric inhibitory polypeptide.

GIP secretion is induced by food ingestion. GIP has a number of physiological effects in tissues, including promotion of fat storage in adipocytes and promotion of pancreatic islet β-cell function and glucose-dependent insulin secretion. GIP and glucagon like polypeptide-1 (GLP-1) are known insulinotropic factors ("incretins"). Intact GIP is rapidly degraded by DPPIV to an inactive form. The insulinotropic effect of GIP is lost in type 2 diabetic patients while GLP-1's incretin effect remains intact (Nauck et al. J. Clinc. Invest. 1993:91:301-307).

The GIP receptor (GIPR) is a member of the secretin-glucagon family of G-protein coupled receptors (GPCRs) having an extracellular N-terminus, seven transmembrane domains and an intracellular C-terminus. The N-terminal extracellular domains of this family of receptors are usually glycosylated and form the recognition and binding domain of the receptor. GIPR is highly expressed in a number of tissues, including the pancreas, gut, adipose tissue, heart, pituitary, adrenal cortex, and brain (Usdin et al., Endocrinology. 1993, 133:2861-2870). Human GIPR comprises 466 amino acids and is encoded by a gene located on chromosome 19q13.3 (Gremlich et al., Diabetes. 1995; 44:1202-8; Volz et al., FEBS Lett. 1995, 373:23-29). Studies have suggested that alternative mRNA splicing results in the production of GIP receptor variants of differing lengths in human, rat and mouse.

GIPR knockout mice (Gipr$^{-/-}$) are resistant to high fat diet-induced weight gain and have improved insulin sensitivity and lipid profiles. (Yamada et al., Diabetes. 2006, 55: S86; Miyawaki et al. Nature Med. 2002, 8:738-742). In addition, a novel small molecule GIPR antagonist SKL-14959 prevents obesity and insulin resistance. (Diabetologia 2008, 51: S373, 44th EASD Annual meeting poster).

Collectively, these links to obesity and insulin resistance imply GIPR inhibition is a useful approach for therapeutic intervention.

Glucagon-like peptide-1 is a 31-amino acid peptide derived from the proglucagon gene. It is secreted by intestinal L-cells and released in response to food ingestion to induce insulin secretion from pancreatic β-cells (Diabetes 2004, 53: S3, 205-214). In addition to the incretin effects, GLP-1 also decreases glucagon secretion, delays gastric emptying and reduces caloric intake (Diabetes Care, 2003, 26 (10): 2929-2940). GLP-1 exerts its effects by activation of the GLP-1 receptor, which belongs to a class B G-protein-coupled receptor (Endocrinology. 1993, 133 (4): 1907-10). The function of GLP-1 is limited by rapid degradation by the DPP-IV enzyme, resulting in a half-life of approximately 2 minutes. Recently, long-lasting GLP-1 receptor agonists (GLP-1 RAs) such as exenatide, liraglutide, dulaglutide have been developed and are now being used clinically to improve glycemic control in patients with type 2 diabetes. Furthermore, GLP-IRAs also promote body weight reduction as well as reduction in blood pressure and plasma cholesterol levels in patients (Bioorg. Med. Chem. Lett 2013, 23:4011-4018).

SUMMARY OF THE INVENTION

In one aspect, the present disclosure provides a method of treating a subject with a metabolic disorder, the method comprising administering to the subject a therapeutically effective amount of a composition comprising a) an antibody or functional fragment thereof that specifically binds to human GIPR, wherein the antibody or functional fragment thereof comprises a light chain variable region and a heavy chain variable region; and b) a GLP-1 receptor agonist, wherein the C-terminus of the GLP-1 receptor agonist is fused to N-terminus of either the light chain variable region or the heavy chain variable region. In one embodiment, the GLP-1 receptor agonist can be fused via a peptide linker.

In one embodiment, the metabolic disorder is a disorder of glucose metabolism. In another embodiment, the glucose metabolism disorder comprises hyperglycemia and administering the antigen binding protein reduces plasma glucose. In another embodiment, the glucose metabolism disorder comprises hyperinsulinemia and administering the antigen binding protein reduces plasma insulin. In another embodiment, the glucose metabolism disorder comprises glucose intolerance and administering the antigen binding protein reduces increases glucose tolerance. In another embodiment, the glucose metabolism disorder comprises insulin resistance and administering the antigen binding protein reduces insulin resistance. In another embodiment, the glucose metabolism disorder comprises diabetes mellitus. In another embodiment, the subject is obese. In another embodiment, administering the composition reduces body weight in an obese subject. In another embodiment, administering the composition reduces body weight gain in an obese subject.

In another embodiment, administering the composition reduces fat mass in an obese subject. In another embodiment, the glucose metabolism disorder comprises insulin resistance and administering the composition reduces insulin resistance in an obese subject. In another embodiment, administering the composition reduces liver steatosis in an obese subject having increased liver steatosis. In another embodiment, administering the composition reduces liver fat content in an obese subject having increased liver fat content.

In one aspect, the composition comprises an antibody or functional fragment thereof that specifically binds to a protein having an amino acid sequence having at least 90% amino acid sequence identity to an amino acid sequence of a human GIPR.

In one embodiment, the human GIPR has a sequence comprising a sequence selected from the group consisting of SEQ ID NO: 3141, SEQ ID NO: 3143, and SEQ ID NO: 3145. In one embodiment, the antibody or functional fragment thereof is a monoclonal antibody, a recombinant antibody, a human antibody, a humanized antibody, a chimeric antibody, a multispecific antibody, or an antibody fragment thereof. In one embodiment, the antibody fragment is a Fab fragment, a Fab' fragment, or a F(ab')2 fragment. In one embodiment, the antibody or functional fragment thereof is of the IgG1-, IgG2- IgG3- or IgG4-type. In one embodiment, the antibody or functional fragment thereof inhibits binding of GIP to the extracellular portion of human GIPR.

In one embodiment, the GLP-1 receptor agonist is GLP-1(7-37) or a GLP-1(7-37) analog. In one embodiment, the GLP-1 receptor agonist is selected from the group consisting of GLP-1(7-37) (SEQ ID NO: 3182);

(SEQ ID NO: 3163)
Exendin-4;

(SEQ ID NO: 3164)
Exendin-3;

(SEQ ID NO: 3165)
$Leu^{14}$-exendin-4;

(SEQ ID NO: 3166)
$Leu^{14}$, $Phe^{25}$-exendin-4;

(SEQ ID NO: 3167)
$Leu^{14}$, $Ala^{19}$, $Phe^{25}$-exendin-4;

(SEQ ID NO: 3168)
exendin-4(1-30);

(SEQ ID NO: 3169)
$Leu^{14}$-exendin-4(1-30);

(SEQ ID NO: 3170)
$Leu^{14}$, $Phe^{25}$-exendin-4(1-30);

(SEQ ID NO: 3171)
$Leu^{14}$, $Ala^{19}$, $Phe^{25}$-exendin-4(1-30);

(SEQ ID NO: 3172)
exendin-4(1-28);

(SEQ ID NO: 3173)
$Leu^{14}$-exendin-4(1-28);

(SEQ ID NO: 3174)
$Leu^{14}$, $Phe^{25}$-exendin-4(1-28);

(SEQ ID NO: 3175)
$Leu^{14}$, $Ala^{19}$, $Phe^{25}$-exendin-4(1-28);

(SEQ ID NO: 3176)
$Leu^{14}$, $Lys^{17,20}$, $Ala^{19}$, $Glu^{21}$, $Phe^{25}$, $Gln^{28}$-

-continued exendin-4;

(SEQ ID NO: 3177)
$Leu^{14}$, $Lys^{17,20}$, $Ala^{19}$, $Glu^{21}$, $Gln^{28}$-exendin-4;

(SEQ ID NO: 3178)
$Phe^{4}$, $Leu^{14}$, $Gln^{28}$, $Lys^{33}$, $Glu^{34}$, $Ile^{35,36}$, $Ser^{37}$-exendin-4(1-37);

(SEQ ID NO: 3179)
$Phe^{4}$, $Leu^{14}$, $Lys^{17,20}$, $Ala^{19}$, $Glu^{21}$, $Gln^{28}$-exendin-4;

(SEQ ID NO: 3180)
$Val^{11}$, $Ile^{13}$, $Leu^{14}$, $Ala^{16}$, $Lys^{21}$, $Phe^{25}$-exendin-4;

(SEQ ID NO: 3181)
exendin-4-$Lys^{40}$;

(SEQ ID NO: 3182)
GLP-1(7-37);

(SEQ ID NO: 3183)
$HXaa_8EGTFTSDVSSYLEXaa_{22}Xaa_{23}AAKEFIXaa_{30}WLXaa_{33}Xaa_{34}G\ Xaa_{36}Xaa_{37}$;

wherein $Xaa_8$ is A, V, or G: $Xaa_{22}$ is G, K, or E; $Xaa_{23}$ is Q or K; $Xaa_{30}$ is A or E; $Xaa_{33}$ is V or K; $Xaa_{34}$ is K, N, or R; $Xaa_{36}$ is R or G; and $Xaa_{37}$ is G, H, P, or absent;

(SEQ ID NO: 3184)
$Arg^{34}$-GLP-1(7-37);

(SEQ ID NO: 3185)
$Glu^{30}$-GLP-1(7-37);

(SEQ ID NO: 3186)
$Lys^{22}$-GLP-1(7-37);

(SEQ ID NO: 3187)
$Gly^{8,36}$, $Glu^{22}$-GLP-1(7-37);

(SEQ ID NO: 3188)
$Val^{8}$, $Glu^{22}$, $Gly^{36}$-GLP-1(7-37);

(SEQ ID NO: 3189)
$Gly^{8,36}$, $Glu^{22}$, $Lys^{33}$, $Asn^{34}$-GLP-1(7-37);

(SEQ ID NO: 3190)
$Val^{8}$, $Glu^{22}$, $Lys^{33}$, $Asn^{34}$, $Gly^{36}$-GLP-1(7-37);

(SEQ ID NO: 3191)
$Gly^{8,36}$, $Glu^{22}$, $Pro^{37}$-GLP-1(7-37);

(SEQ ID NO: 3192)
$Val^{8}$; $Glu^{22}$, $Gly^{36}$, $Pro^{37}$-GLP-1(7-37);

(SEQ ID NO: 3193)
$Gly^{8,36}$, $Glu^{22}$, $Lys^{33}$, $Asn^{34}$, $Pro^{37}$-GLP-1(7-37);

(SEQ ID NO: 3194)
$Val^{8}$, $Glu^{22}$, $Lys^{33}$, $Asn^{34}$, $Gly^{36}$, $Pro^{37}$-GLP-1(7-37);

(SEQ ID NO: 3195)
$Gly^{8,36}$, $Glu^{22}$-GLP-1(7-36);

(SEQ ID NO: 3196)
$Val^{8}$, $Glu^{22}$, $Gly^{36}$-GLP-1(7-36);

(SEQ ID NO: 3197)
$Val^{8}$, $Glu^{22}$, $Asn^{34}$, $Gly^{36}$-GLP-1(7-36);

-continued (SEQ ID NO: 3198)
Gly$^{8,36}$, Glu$^{22}$, Asn$^{34}$-GLP-1(7-36);

(SEQ ID NO: 3199)
GLP-1 analog;

(SEQ ID NO: 3200)
GLP-1 analog;

(SEQ ID NO: 3201)
[Gly$^{8,36}$, Glu$^{22}$]GLP-1(7-37);

(SEQ ID NO: 3202)
HAEGTFTSDVSSYLEGQAAKEFIAWLVKGRG;

(SEQ ID NO: 3203)
AEGTFTSDVSSYLEGQAAKEFIAWLVKGRG;

(SEQ ID NO: 3204)
EGTFTSDVSSYLEGQAAKEFIAWLVKGRG;

(SEQ ID NO: 3205)
HGEGTFTSDVSSYLEGQAAKEFIAWLVKGRG;

(SEQ ID NO: 3206)
HGEGTFTSDVSSYLEGQAAKEFIAWLVKGR;

(SEQ ID NO: 3207)
HLEGTFTSDVSSYLEGQAAKEFIAWLVKGRG;

(SEQ ID NO: 3208)
HGEGTFTSDLSKQMEEEAVRLF;

(SEQ ID NO: 3209)
HGEGTFTSDLSKQMEEEAVRLFI;

(SEQ ID NO: 3210)
HGEGTFTSDVSSYLEGQAAKEFIAWLVKGGG;

(SEQ ID NO: 3211)
HGEGTFTSDLSKQMEEEAVRLAAQAAQQGGG;

(SEQ ID NO: 3212)
HSEGTFTSDVSSYLEEQAAKEFIAWLVKGGG;

(SEQ ID NO: 3213)
HSQGTFTSDVSSYLEEQAAKEFIAWLVKGGG;

(SEQ ID NO: 3214)
HGDGTFTSDVSSYLEEQAAKEFIAWLVKGGG;

(SEQ ID NO: 3215)
HSDGTFTSDVSSYLEEQAAKEFIAWLVKGGG;

(SEQ ID NO: 3216)
HSEGTFTSDVSSYLEEQAAKEFIEWLVKGGG;

(SEQ ID NO: 3217)
HSQGTFTSDVSSYLEEQAAKEFIEWLVKGGG;

(SEQ ID NO: 3218)
HGDGTFTSDVSSYLEEQAAKEFIEWLVKGGG;

(SEQ ID NO: 3219)
HSDGTFTSDVSSYLEEQAAKEFIEWLVKGGG;

(SEQ ID NO: 3220)
HGEGTFTSDVSSYLEEQAAKEFIAWLKNGGG;

(SEQ ID NO: 3221)
HSEGTFTSDVSSYLEEQAAKEFIAWLKNGGG;

(SEQ ID NO: 3222)
HSQGTFTSDVSSYLEEQAAKEFIAWLKNGGG;

(SEQ ID NO: 3223)
HGDGTFTSDVSSYLEEQAAKEFIAWLKNGGG;

(SEQ ID NO: 3224)
HSDGTFTSDVSSYLEEQAAKEFIAWLKNGGG;

-continued (SEQ ID NO: 3225)
HSEGTFTSDVSSYLEEQAAKEFIEWLKNGGG;

(SEQ ID NO: 3226)
HSQGTFTSDVSSYLEEQAAKEFIEWLKNGGG;

(SEQ ID NO: 3227)
HGDGTFTSDVSSYLEEQAAKEFIEWLKNGGG;

(SEQ ID NO: 3228)
HSDGTFTSDVSSYLEEQAAKEFIEWLKNGGG;

(SEQ ID NO: 3229)
HGEGTFTSDVSSYLEEQAAKEFIEWLKNEGG;

(SEQ ID NO: 3230)
HSEGTFTSDVSSYLEEQAAKEFIEWLKNEGG;

(SEQ ID NO: 3231)
HGEGTFTSDVSSYLEEQAAKEFIEWLKNPGG;

(SEQ ID NO: 3232)
HSEGTFTSDVSSYLEEQAAKEFIEWLKNPGG;

(SEQ ID NO: 3233)
HGEGTFTSDVSSYLEEQAAKEFIEWLKNQGG;

(SEQ ID NO: 3234)
HSEGTFTSDVSSYLEEQAAKEFIEWLKNQGG;

(SEQ ID NO: 3235)
HGEGTFTSDVSSYLEEQAAKEFIEWLKNTGG;

(SEQ ID NO: 3236)
HSEGTFTSDVSSYLEEQAAKEFIEWLKNTGG;

(SEQ ID NO: 3237)
HGEGTFTSDVSSYLEEQAAKEFIEWLKNVGG;

(SEQ ID NO: 3238)
HSEGTFTSDVSSYLEEQAAKEFIEWLKNVGG;

(SEQ ID NO: 3239)
HGEGTFTSDVSSYLEEQAAKEFIEWLKQGGG;

(SEQ ID NO: 3240)
HSEGTFTSDVSSYLEEQAAKEFIEWLKQGGG;

(SEQ ID NO: 3241)
HGEGTFTSDVSSYLEEQAAKEFIAWLVKGGG;

(SEQ ID NO: 3242)
HGEGTFTSDVSXYLEEQAAKEFIAWLVKGGG;

(SEQ ID NO: 3243)
HVEGTFTSDVSSYLEGQAAKEFIAWLVKGGG;

(SEQ ID NO: 3244)
HSEGTFTSDVSSYLEGQAAKEFIAWLVKGGG;

(SEQ ID NO: 3245)
HGQGTFTSDVSSYLEGQAAKEFIAWLVKGGG;

(SEQ ID NO: 3246)
HVQGTFTSDVSSYLEGQAAKEFIAWLVKGGG;

(SEQ ID NO: 3247)
HSQGTFTSDVSSYLEGQAAKEFIAWLVKGGG;

(SEQ ID NO: 3248)
HVDGTFTSDVSSYLEGQAAKEFIAWLVKGGG;

(SEQ ID NO: 3249)
HGHGTFTSDVSSYLEGQAAKEFIAWLVKGGG;

(SEQ ID NO: 3250)
HVHGTFTSDVSSYLEGQAAKEFIAWLVKGGG;

(SEQ ID NO: 3251)
HSHGTFTSDVSSYLEGQAAKEFIAWLVKGGG;

-continued (SEQ ID NO: 3252)
HGDGTFTSDVSSYLEGQAAKEFIAWLVKGGG;

(SEQ ID NO: 3253)
HSDGTFTSDVSSYLEGQAAKEFIAWLVKGGG;

(SEQ ID NO: 3254)
HGEGTFTSDVSSYLEEQAAKEFIEWLKNGGG;

(SEQ ID NO: 3255)
HGEGTFTSDVSSYLEEQAAKEFIEWLVKGGG;

(SEQ ID NO: 3256)
HGEGTFTSDYSSYLEEQAAKEFIEWLKNGGG;

(SEQ ID NO: 3257)
HGEGTFTSEVSSYLEGQAAKEFIEWLKNGGG;

(SEQ ID NO: 3258)
HSEGTFTSDLSKQMEEEAVRLFAAQAAQQGGG;

(SEQ ID NO: 3259)
HSQGTFTSDLSKQMEEEAVRLFAAQAAQQGGG;

(SEQ ID NO: 3260)
HGDGTFTSDLSKQMEEEAVRLFAAQAAQQGGG;

(SEQ ID NO: 3261)
HSDGTFTSDLSKQMEEEAVRLFAAQAAQQGGG;

(SEQ ID NO: 3262)
HGEGTFTSDLSKQMEEEAVRLFAAQAAQQGGG;

(SEQ ID NO: 3263)
HGEGTFTSDLSKQMEEEAVRLFIEWLKNGG;

(SEQ ID NO: 3264)
HGEGTFTSDVSSYLEGEAVRLFIEWLKNGG;

(SEQ ID NO: 3265)
HGEGTFTSDLSKQMEEEAVRLFIEWLKNGGPSSGAPPPS;

(SEQ ID NO: 3266)
HGEGTFTSDVSSYLEGEAVRLFIEWLKNGGPSSGAPPPS;

(SEQ ID NO: 3267)
HHGEGTFTSDVSSYLEEQAAKEFIEWLKNGGG;

(SEQ ID NO: 3268)
HHGEGTFTSDVSSYLEEQAAKEFIEWLKDGGG;

(SEQ ID NO: 3269)
HHGEGTFTSDVSSYLEEQAAKEFIEWLKQGGG;

(SEQ ID NO: 3270)
HHGEGTFTSDVSSYLEEQAAKEFIEWLKNQGG;

(SEQ ID NO: 3271)
HHGEGTFTSDVSSYLEEQAAKEFIEWLKNTGG;

(SEQ ID NO: 3272)
HHGEGTFTSDVSSYLEEQAAKEFIEWLKNVGG;

(SEQ ID NO: 3273)
HHGEGTFTSDVSSYLEEQAAKEFIEWLKNPGG;

(SEQ ID NO: 3274)
HHGEGTFTSDVSSYLEEQAAKEFIEWLKNEGG;

(SEQ ID NO: 3275)
HGAGTFTSDVSSYLEGQAAKEFIAWLVKG;

(SEQ ID NO: 3276)
HGDGTFTSDVSSYLEGQAAKEFIAWLVKG;

(SEQ ID NO: 3277)
HGLGTFTSDVSSYLEGQAAKEFIAWLVKG;

(SEQ ID NO: 3278)
HGVGTFTSDVSSYLEGQAAKEFIAWLVKG;

-continued (SEQ ID NO: 3279)
HGFGTFTSDVSSYLEGQAAKEFIAWLVKG;

(SEQ ID NO: 3280)
HGYGTFTSDVSSYLEGQAAKEFIAWLVKG;

(SEQ ID NO: 3281)
HGTGTFTSDVSSYLEGQAAKEFIAWLVKG;

(SEQ ID NO: 3282)
HGNGTFTSDVSSYLEGQAAKEFIAWLVKG;

(SEQ ID NO: 3283)
HGHGTFTSDVSSYLEGQAAKEFIAWLVKG;

(SEQ ID NO: 3284)
HGKGTFTSDVSSYLEGQAAKEFIAWLVKG;

(SEQ ID NO: 3285)
HGIGTFTSDVSSYLEGQAAKEFIAWLVKG;

(SEQ ID NO: 3286)
HGWGTFTSDVSSYLEGQAAKEFIAWLVKG;

(SEQ ID NO: 3287)
HGPGTFTSDVSSYLEGQAAKEFIAWLVKG;

(SEQ ID NO: 3288)
HGSGTFTSDVSSYLEGQAAKEFIAWLVKG;

(SEQ ID NO: 3289)
HGRGTFTSDVSSYLEGQAAKEFIAWLVKG;

(SEQ ID NO: 3290)
AHGEGTFTSDVSSYLEGQAAKEFIAWLVKG;

(SEQ ID NO: 3291)
GHGEGTFTSDVSSYLEGQAAKEFIAWLVKG;

(SEQ ID NO: 3292)
HHGEGTFTSDVSSYLEGQAAKEFIAWLVKG;

(SEQ ID NO: 3293)
HHEGTFTSDVSSYLEGQAAKEFIAWLVKG;

(SEQ ID NO: 3294)
HGEATFTSDVSSYLEGQAAKEFIAWLVKG;

(SEQ ID NO: 3295)
HGESTFTSDVSSYLEGQAAKEFIAWLVKG;

(SEQ ID NO: 3296)
HGEVTFTSDVSSYLEGQAAKEFIAWLVKG;

(SEQ ID NO: 3297)
HGEKTFTSDVSSYLEGQAAKEFIAWLVKG;

(SEQ ID NO: 3298)
HGEETFTSDVSSYLEGQAAKEFIAWLVKG;

(SEQ ID NO: 3299)
HGEGTFTSDVSSYLEGQAAKEFIAWLVKG;

(SEQ ID NO: 3300)
HVEGTFTSDVSSYLEGQAAKEFIAWLVKGRG;

(SEQ ID NO: 3301)
HSEGTFTSDVSSYLEGQAAKEFIAWLVKGRG;
and (SEQ ID NO: 3302)
HGQGTFTSDVSSYLEGQAAKEFIAWLVKGRG.

In one embodiment, the peptide linker comprises a sequence selected from the group consisting of $(Gly_3Ser)_2$ (SEQ ID NO: 3303), $(Gly_4Ser)_2$ (SEQ ID NO: 3304), $(Gly_3Ser)_3$ (SEQ ID NO: 3305), $(Gly_4Ser)_3$ (SEQ ID NO: 3306), $(Gly^3Ser)_4$ (SEQ ID NO: 3307), $(Gly_4Ser)_4$ (SEQ ID NO: 3308), $(Gly_3Ser)_5$ (SEQ ID NO: 3309), $(Gly_4Ser)_5$ (SEQ ID NO: 3310), $(Gly_3Ser)_6$ (SEQ ID NO: 3311), $(Gly_4Ser)_6$ (SEQ ID NO: 3359), GGEGGG (SEQ ID NO: 3312);

```
                         (SEQ ID NO: 3313)
GGEEEGGG;
                         (SEQ ID NO: 3314)
GEEEG;
                         (SEQ ID NO: 3315)
GEEE;
                         (SEQ ID NO: 3316)
GGDGGG;
                         (SEQ ID NO: 3317)
GGDDDGG;
                         (SEQ ID NO: 3318)
GDDDG;
                         (SEQ ID NO: 3319)
GDDD;
                         (SEQ ID NO: 3320)
GGGGSDDSDEGSDGEDGGGGS;
                         (SEQ ID NO: 3321)
WEWEW;
                         (SEQ ID NO: 3322)
FEFEF;
                         (SEQ ID NO: 3323)
EEEWWW;
                         (SEQ ID NO: 3324)
EEEFFF;
                         (SEQ ID NO: 3325)
WWEEEWW;
                         (SEQ ID NO: 3326)
FFEEEFF.
                         (SEQ ID NO: 3327)
GGGG;
                         (SEQ ID NO: 3328)
GGGGSGGGG;
                         (SEQ ID NO: 3329)
GAPAPAPAPG;
                         (SEQ ID NO: 3330)
GGGGAGGGGAGGGG;
                         (SEQ ID NO: 3331)
GAPAPAPAPAPAPG;
                         (SEQ ID NO: 3332)
GAPAPAPAPAPAPAPAPG;
                         (SEQ ID NO: 3333)
GGGGAGGGGAGGGGAGGGG;
                         (SEQ ID NO: 3334)
GAPAPAPAPAPAPAPAPAPAPG;
                         (SEQ ID NO: 3335)
GSGSATGGSGSVASSGSGSATGS;
and
                         (SEQ ID NO: 3336)
GSGSATGGSGSVASSGSGSATHL.
```

BRIEF DESCRIPTION OF THE DRAWINGS

FIG. 1A-1B: Synthetic Peptides (FIG. 1A discloses SEQ ID NOS 3948 and 3275-3298 and FIG. 1B discloses SEQ ID NOS 3948 and 3299-3302, all respectively, in order of appearance)

FIG. 2: Results initial GLP-1 SAR screen: Expressible Series (FIG. 2 discloses SEQ ID NOS 3182, 3182, 3203-3206, 3299, 3207 and 3300-3302, respectively, in order of appearance)

FIG. 4: GLP1 N-terminal Variants Summary HC of 6H1 Ab with 1Kmod Linker

FIG. 5A-5C: In vivo pharmacodynamic evaluation of GLP1 variants and linkers in mice FIG. 6A-6C: In vivo pharmacodynamic evaluation of GLP1 variants in mice

FIG. 9: GLP1 Linker Variants Summary HC of 6H1 Ab GLP1 (A2G/R30G) (FIG. 9 discloses SEQ ID NOS 3327-3328, 3330, 3333, 3331-3332, 3334, 3336 and 3333-3334, respectively, in order of appearance)

FIG. 11A-11C: In vivo pharmacodynamic evaluation of linker variants in mice FIG. 13: Recombinant N-term & C-term GLP1 Analogues and Linkers (FIG. 13 discloses SEQ ID NOS 3364 and 3333-3334, respectively, in order of appearance)

FIG. 14: 1K Linker Variants

FIG. 15: (G4A)3G4 Linker Variants (SEQ ID NO: 3333)

FIG. 16: G(AP)10G Linker Variants (SEQ ID NO: 3334)

FIG. 17: GLP1 N-terminal Variants Summary Fused to HC of 6H1 Ab (FIG. 17 discloses SEQ ID NOS 3364, 3336 and 3333-3334, respectively in order of appearance)

FIG. 18: Signal Sequence Processing May Be Responsible for Observed HG/E Cleavage FIG. 19: GLP1 C-terminal Variants Summary Fused to HC of 6H1 Ab (FIG. 19 discloses SEQ ID NOS 3364, 3336 and 3333-3334, respectively, in order of appearance)

FIG. 23: GLP1 Linkers Summary Fused to HC of 6H1 Ab (FIG. 23 discloses SEQ ID NOS 3333-3334 and 3364, respectively, in order of appearance)

FIG. 25: Recombinant C-term GLP1 Analogues and Linkers (FIG. 25 discloses SEQ ID NOS 3333-3334, respectively, in order of appearance)

FIG. 26: Mouse PK study (FIG. 26 discloses SEQ ID NO: 3365)

FIG. 28: Recombinant C-term GLP1 Analogues and Linkers (FIG. 28 discloses SEQ ID NO: 3333)

FIG. 29: GLP1 2G10 Fusions In Vitro Activity

FIG. 30: Mouse PK study (FIG. 30 discloses SEQ ID NO: 3365)

DETAILED DESCRIPTION OF THE INVENTION

Figure 3:
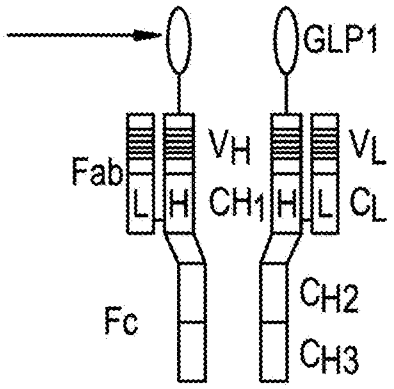
FIG. 3: Recombinant N-terminal Analogues
Figures 7A, 7B:
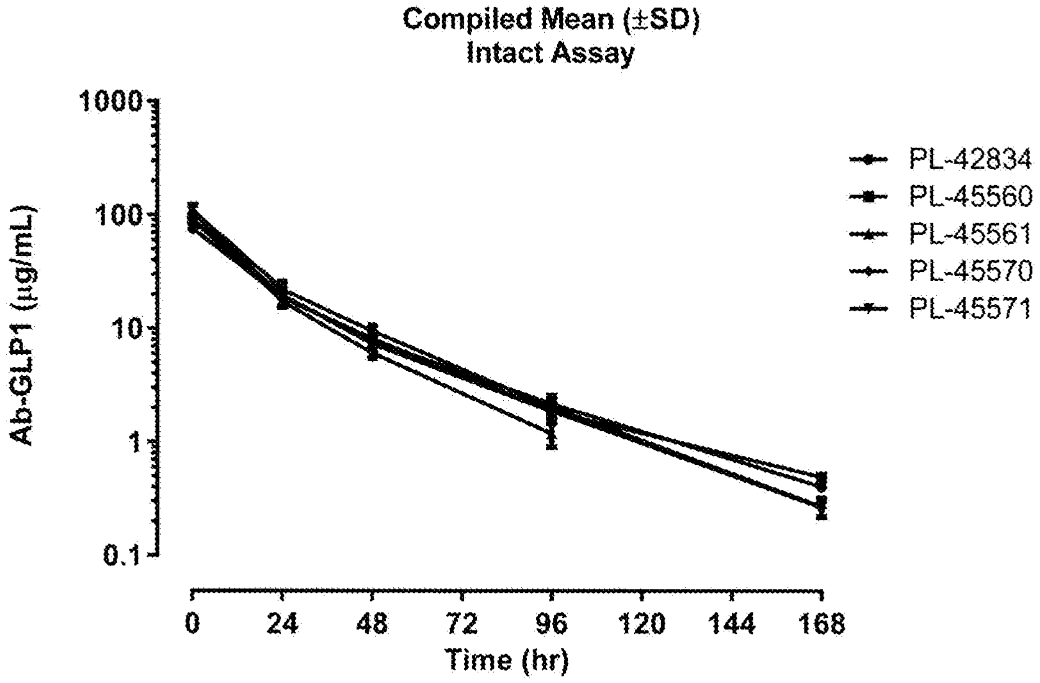
FIG. 7A-7E: PK N-terminal Variants
Figures 7C, 7D, 7E:
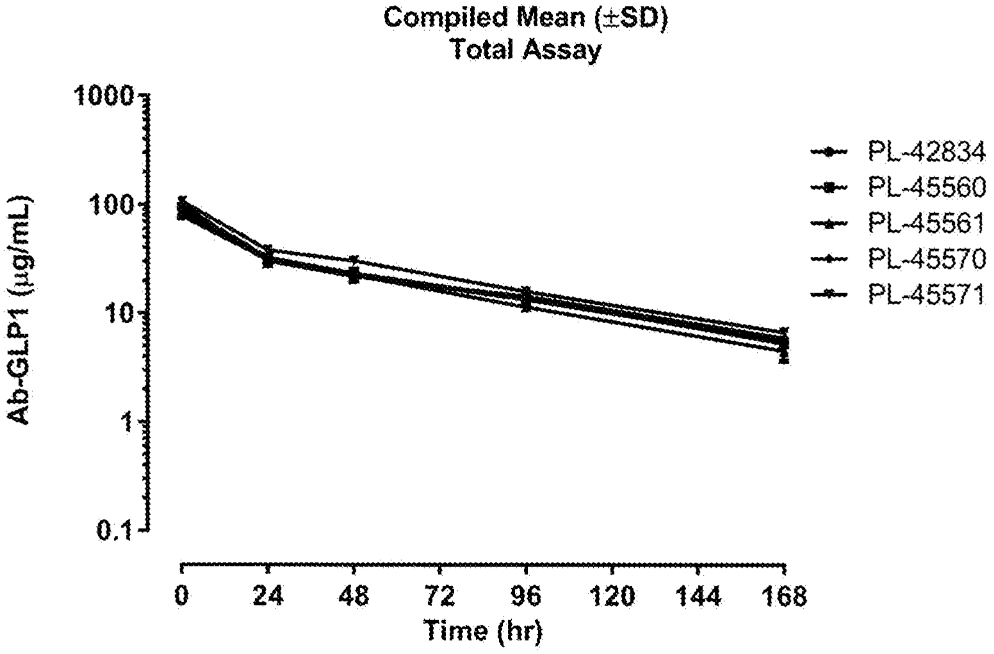
Figure 8:
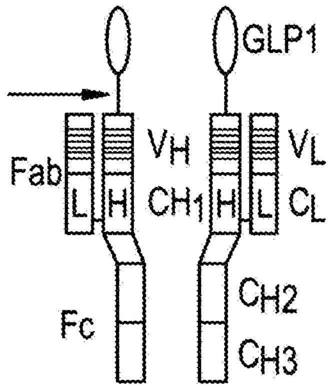
FIG. 8: Recombinant Linker Analogues (FIG. 8 discloses SEQ ID NOS 3327-3328, 3330, 3333, 3329, 3331-3332 and 3334, respectively, in order of appearance)
Figure 10A:
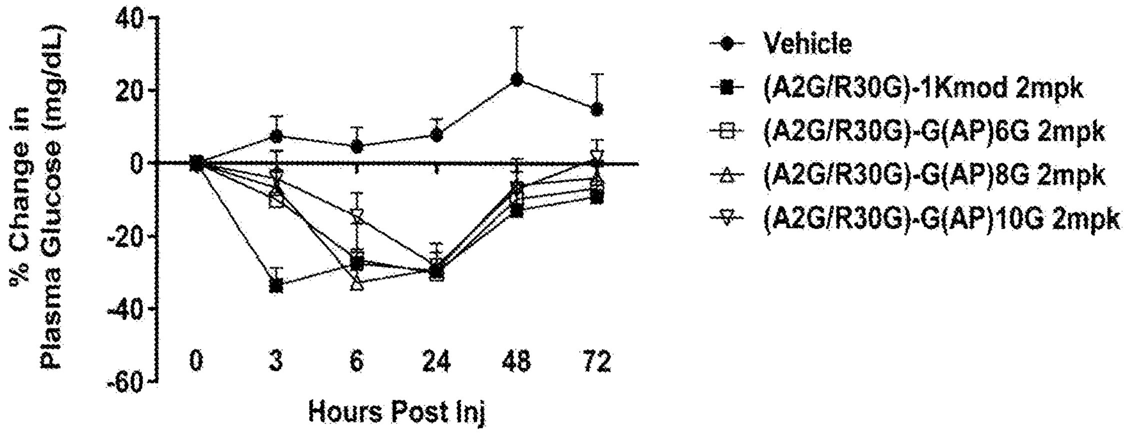
FIG. 10A-10E: GLP1 Linker Variants Fused to HC of 6H1 Ab in Mice
Figure 10B:
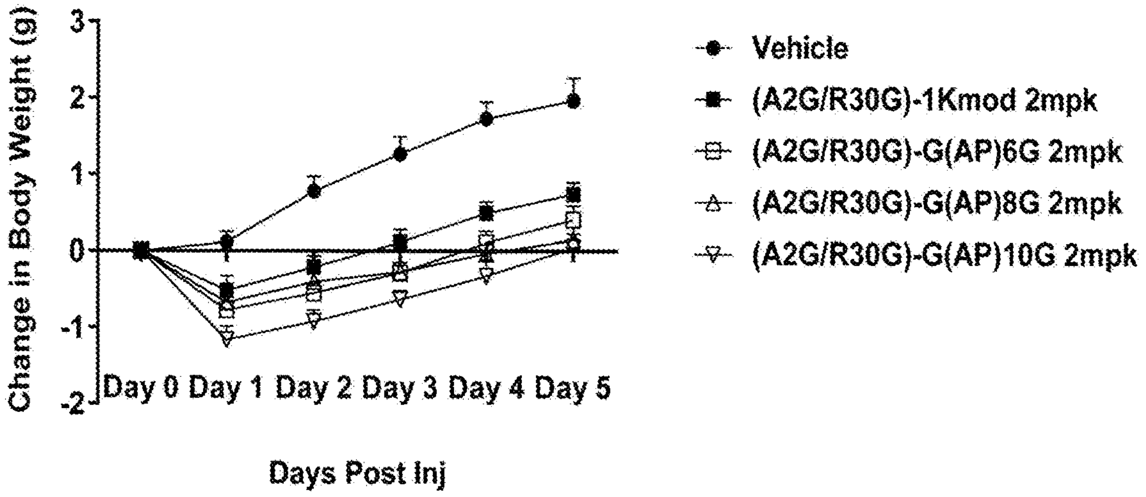
Figure 10C:
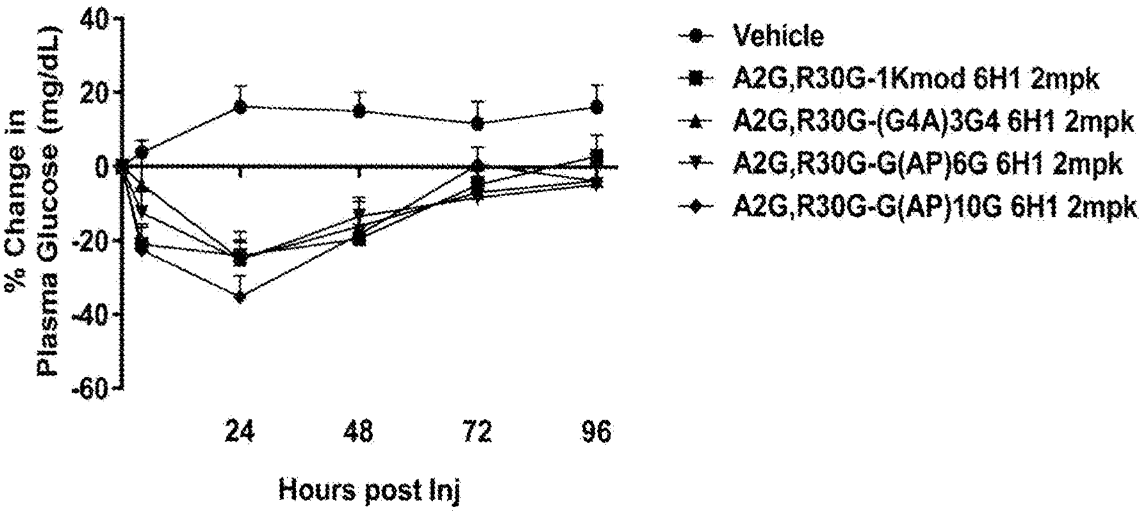
Figures 10D, 10E:
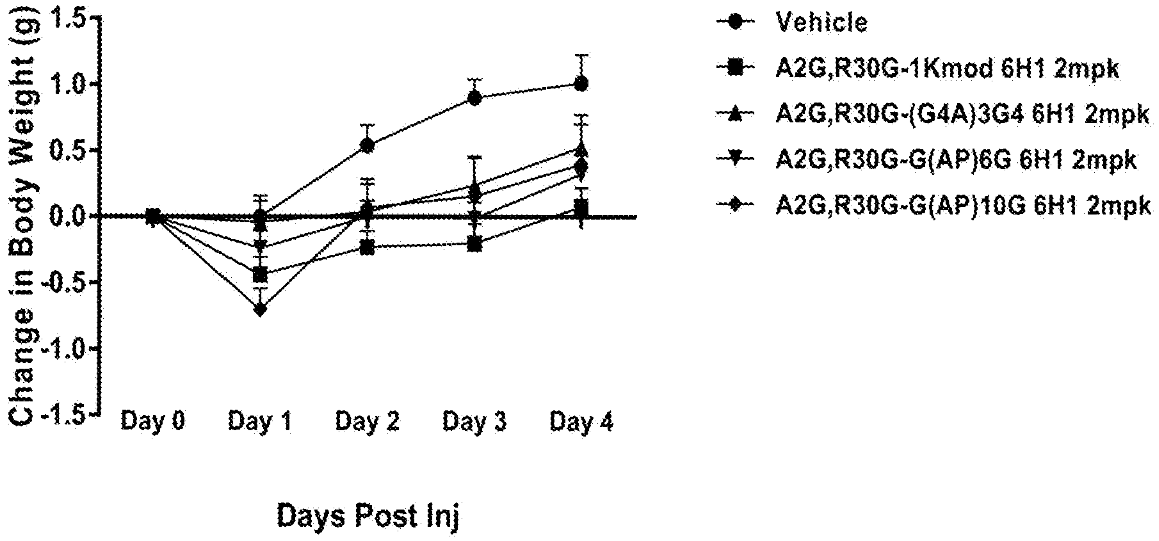
Figures 12A, 12B:
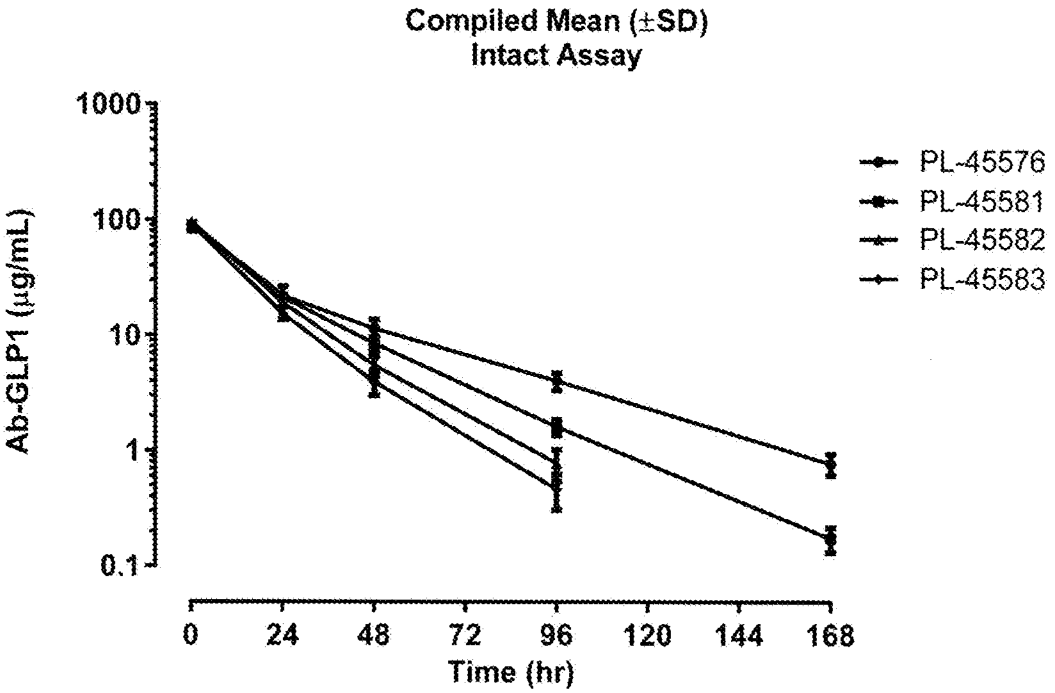
FIG. 12A-12E: PK Linker Variants
Figures 12C, 12D, 12E:
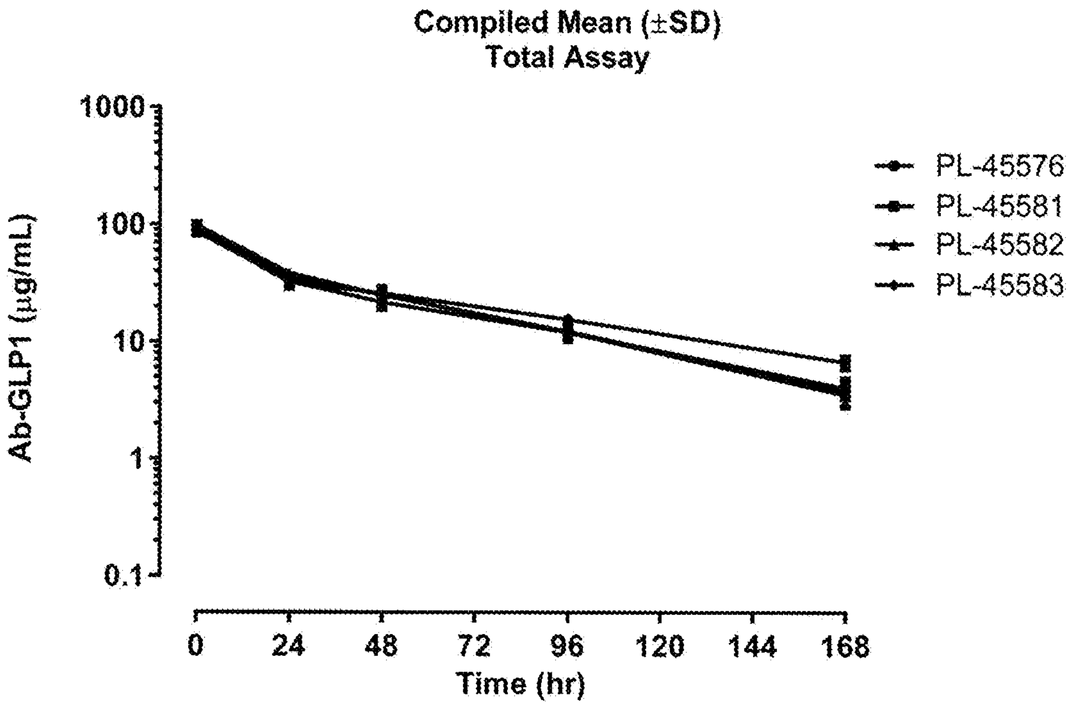
Figures 20A, 20B:
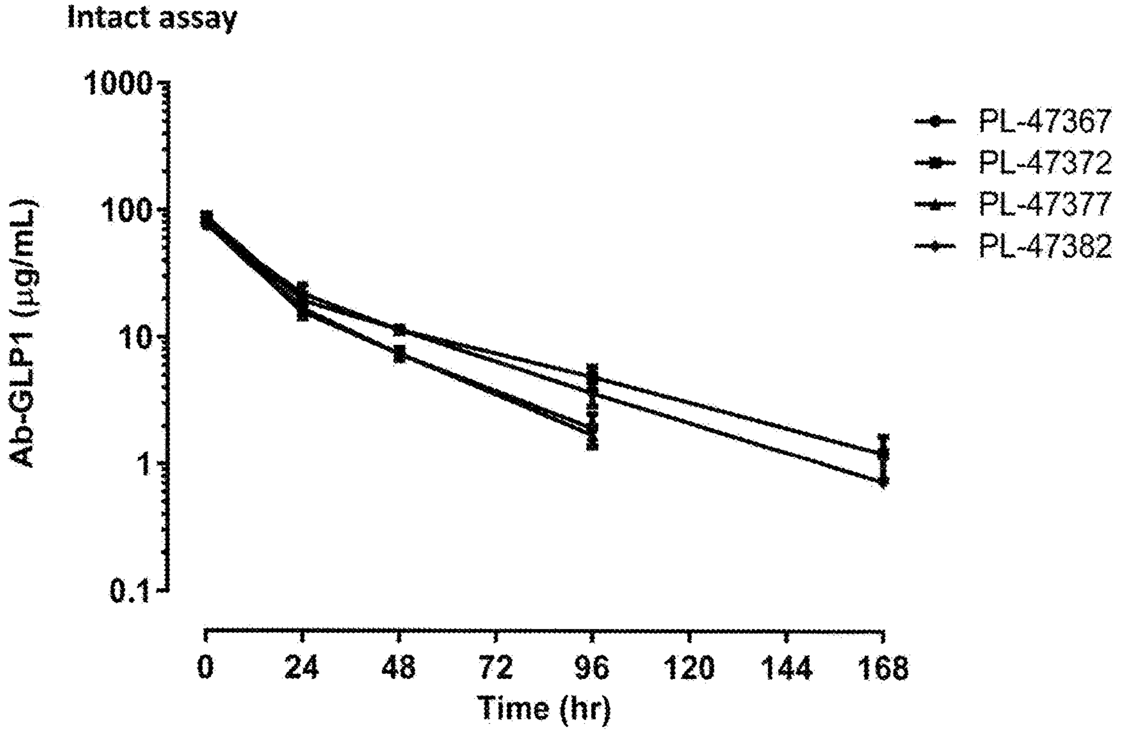
FIG. 20A-20D: 1Kmod Linker
Figures 20C, 20D:
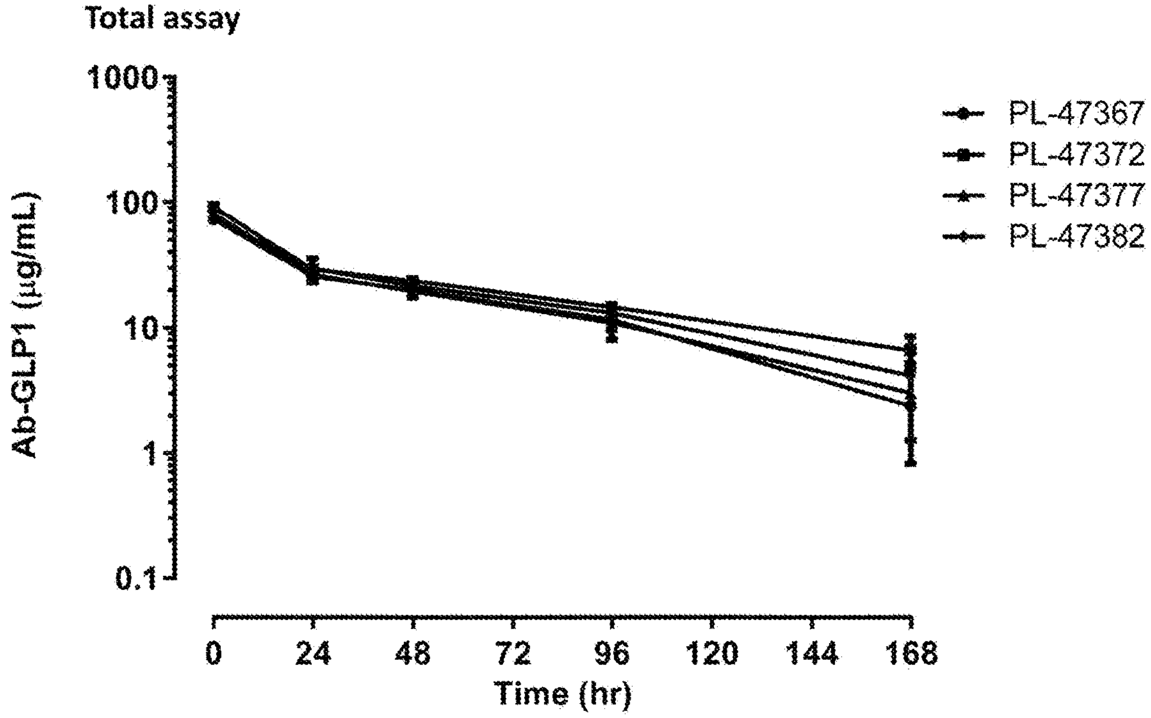
Figures 21A, 21B:
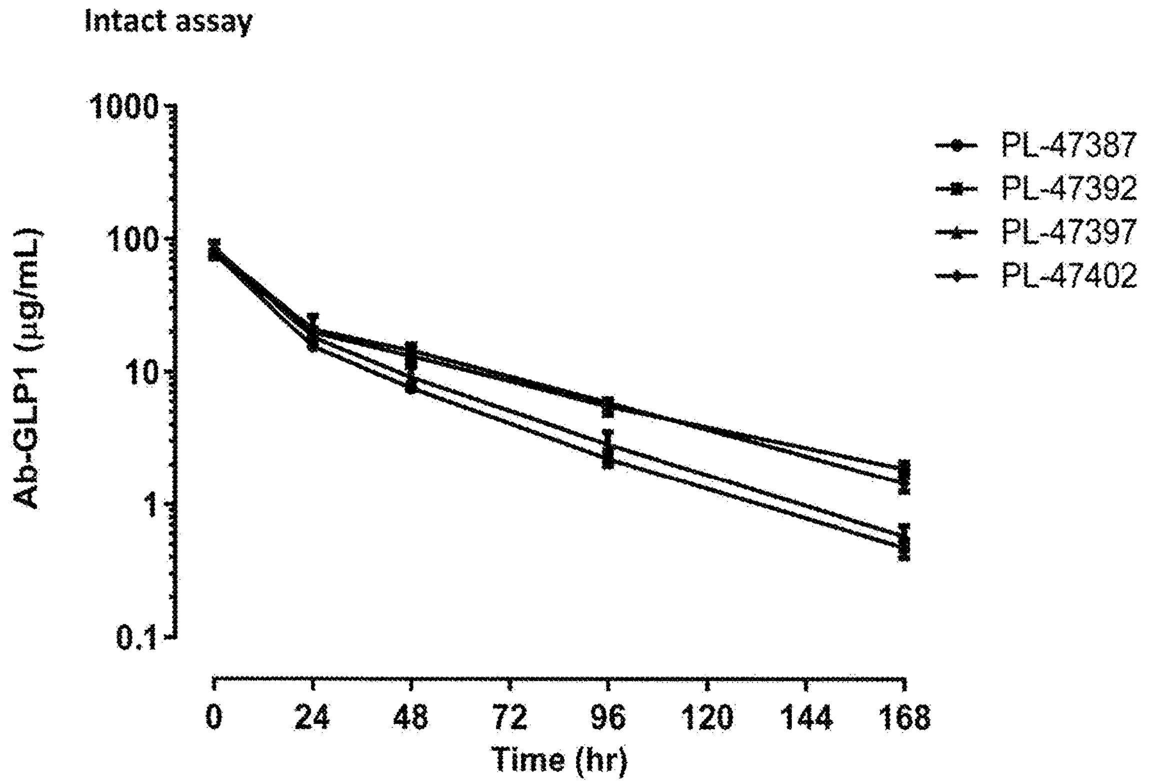
FIG. 21A-21D: (G4A) 3G4 Linker (SEQ ID NO: 3333)
Figures 21C, 21D:
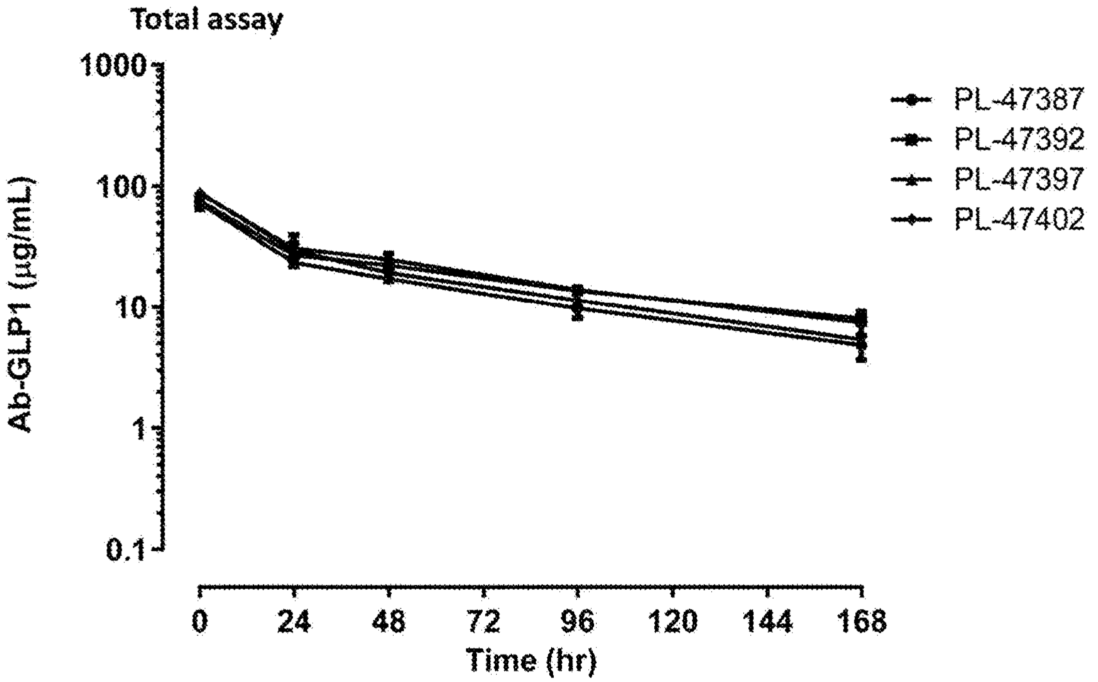
Figures 22A, 22B:
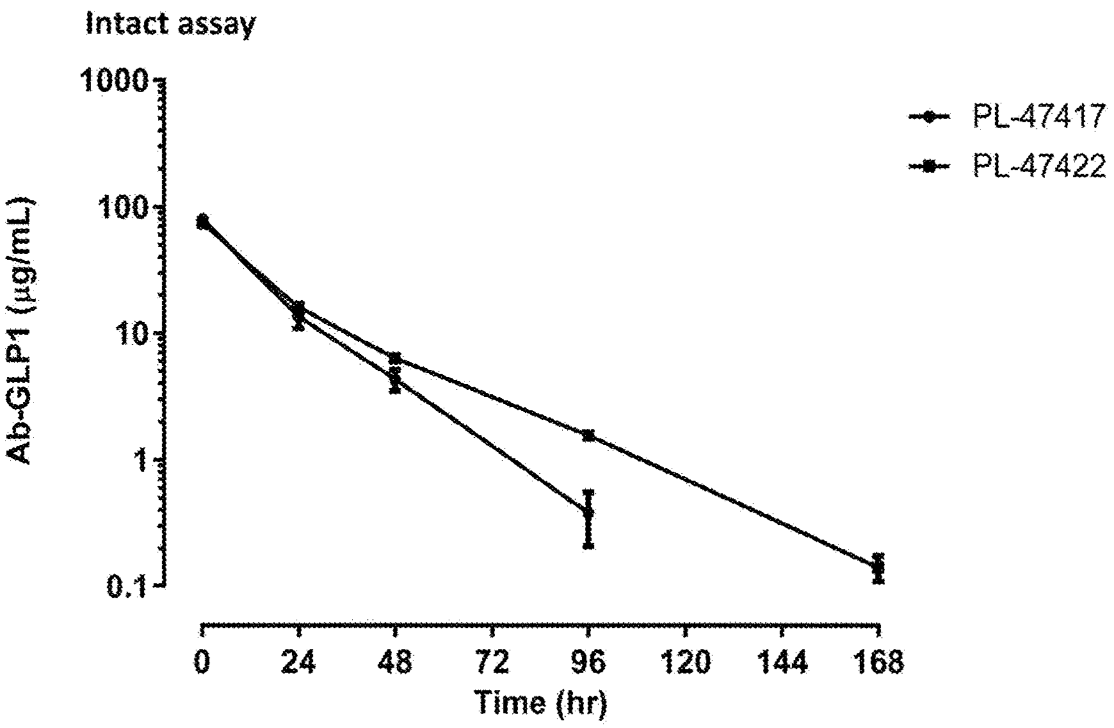
FIG. 22A-22D: G (AP) 10G Linker (SEQ ID NO: 3334)
Figures 22C, 22D:
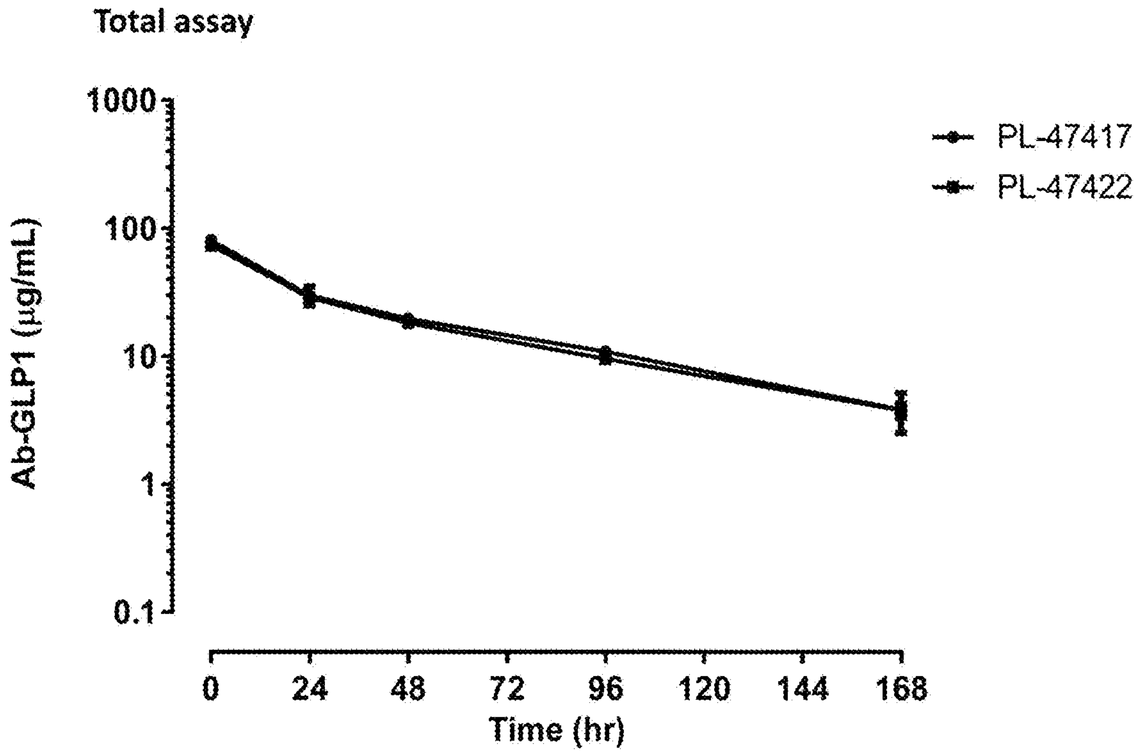
Figures 24A, 24B:
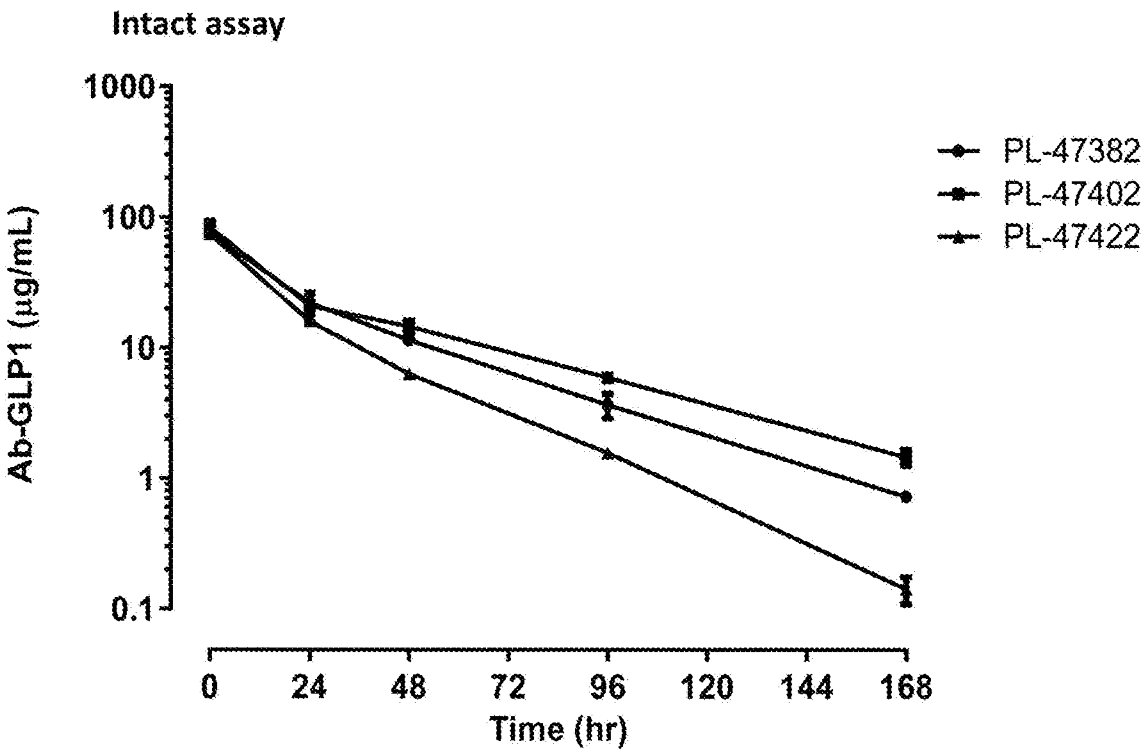
FIG. 24A-24D: linker comparison with A24E/V27K/K28N (FIG. 24B discloses SEQ ID NOS 3333-3334 and FIG. 24D discloses SEQ ID NOS 3333-3334, all respectively, in order of appearance)
Figures 24C, 24D:
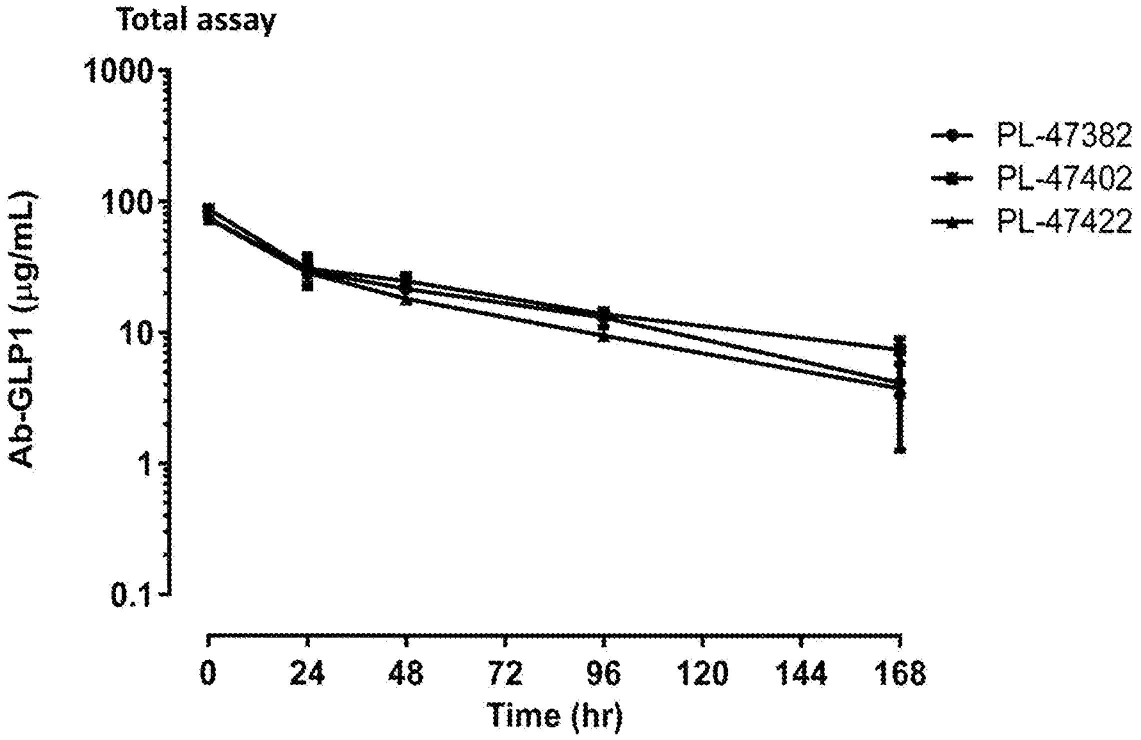
Figures 27A, 27B:
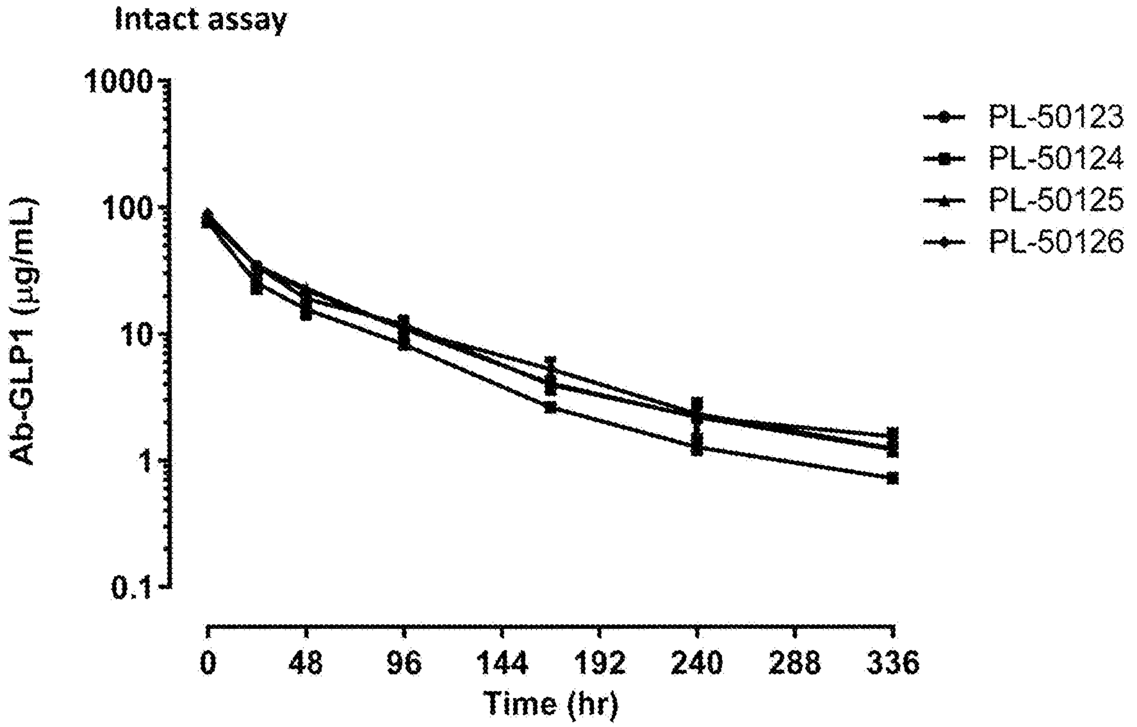
FIG. 27A-27D: Concentration-time data and PK
Figures 27C, 27D:
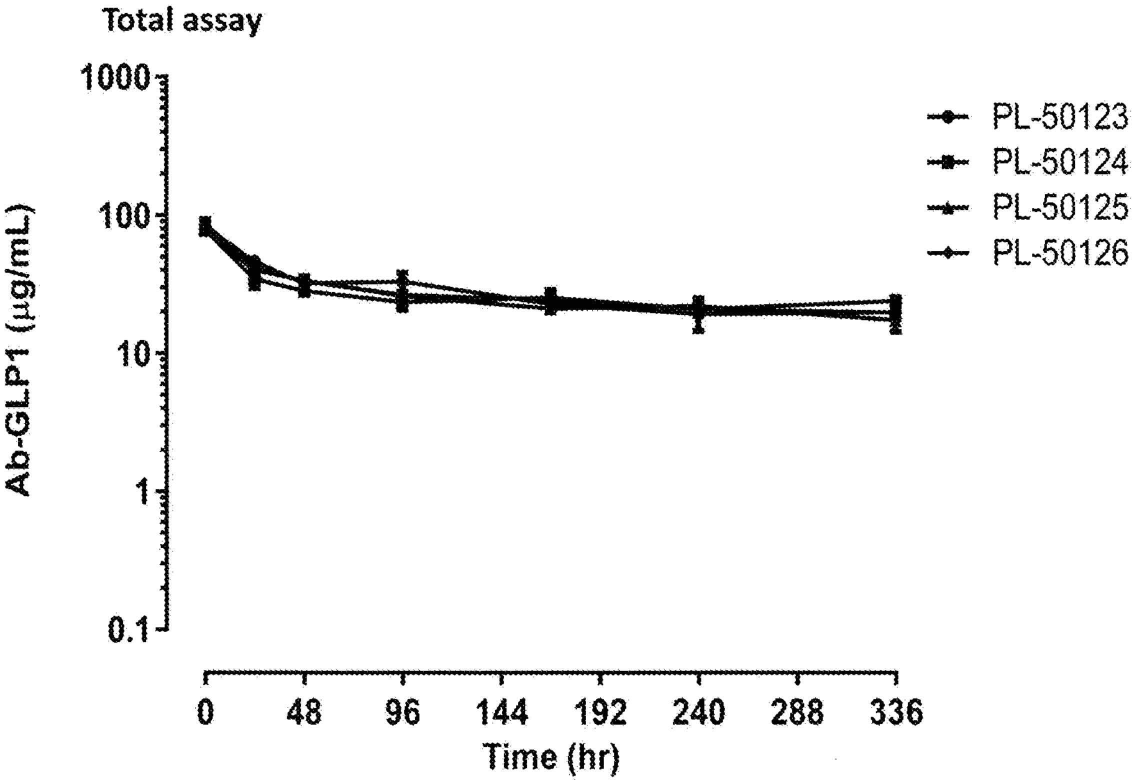
Figures 31A, 31B:
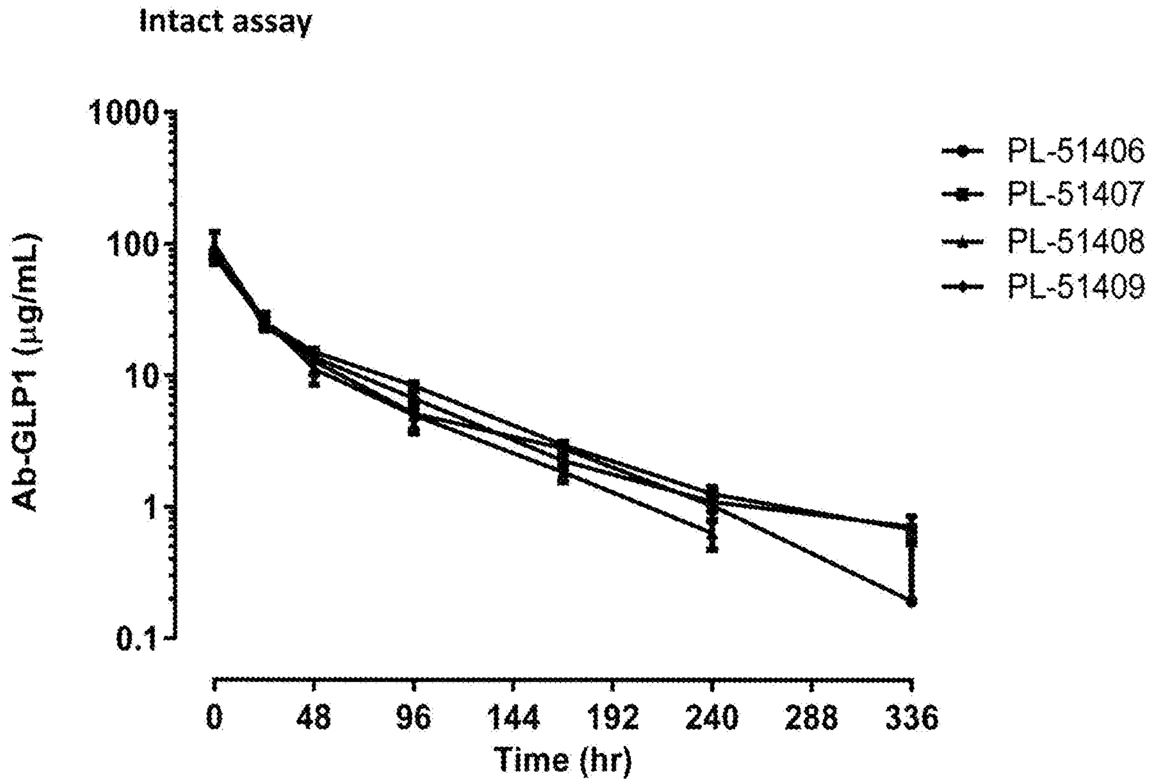
FIG. 31A-31D: Concentration-time data and PK Single
Figures 31C, 31D:
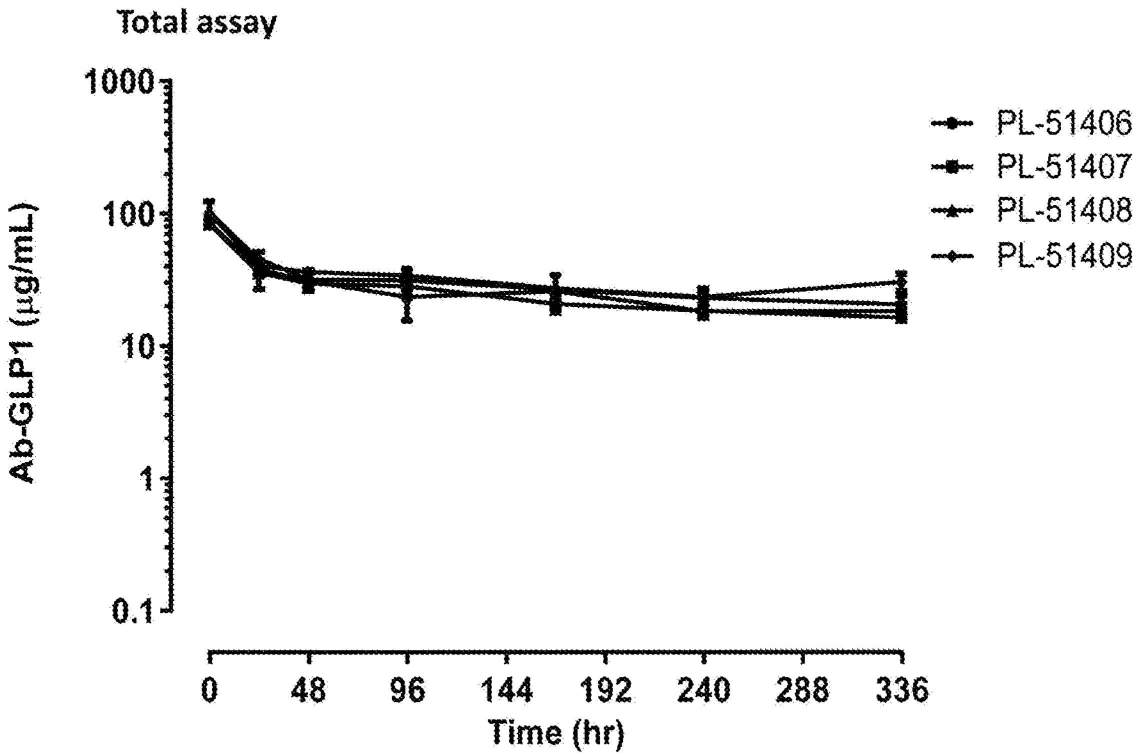

The present disclosure provides a method of treating a metabolic disorder, such as a disorder of glucose metabolism (e.g. Type 2 diabetes, elevated glucose levels, elevated insulin levels, dyslipidemia, metabolic syndrome (Syndrome X or insulin resistance syndrome), glucosuria, metabolic acidosis, diabetic neuropathy, diabetic nephropathy, diabetic retinopathy, diabetic cardiomyopathy, Type 1 diabetes, obesity and conditions exacerbated by obesity) by blocking or interfering with the biological activity of GIP. In one embodiment, a therapeutically effective amount of an isolated human GIPR binding protein is administered to a subject in need thereof. Methods of administration and delivery are also provided.

Recombinant polypeptide and nucleic acid methods used herein, including in the Examples, are generally those set forth in Sambrook et al., Molecular Cloning: A Laboratory Manual (Cold Spring Harbor Laboratory Press, 1989) or Current Protocols in Molecular Biology (Ausubel et al., eds., Green Publishers Inc, and Wiley and Sons 1994), both of which are incorporated herein by reference for any purpose.

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001), Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

It should be understood that this invention is not limited to the particular methodology, protocols, and reagents, etc., described herein and as such may vary. The terminology used herein is for the purpose of describing particular embodiments only, and is not intended to limit the scope of the disclosed, which is defined solely by the claims.

Other than in the operating examples, or where otherwise indicated, all numbers expressing quantities of ingredients or reaction conditions used herein should be understood as modified in all instances by the term "about." The term "about" when used in connection with percentages may mean ±1%.

Following convention, as used herein "a" and "an" mean "one or more" unless specifically indicated otherwise.

As used herein, the terms "amino acid" and "residue" are interchangeable and, when used in the context of a peptide or polypeptide, refer to both naturally occurring and synthetic amino acids, as well as amino acid analogs, amino acid mimetics and non-naturally occurring amino acids that are chemically similar to the naturally occurring amino acids.

A "naturally occurring amino acid" is an amino acid that is encoded by the genetic code, as well as those amino acids that are encoded by the genetic code that are modified after synthesis, e.g., hydroxyproline, γ-carboxyglutamate, and O-phosphoserine. An amino acid analog is a compound that has the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs can have modified R groups (e.g., norleucine) or modified peptide backbones, but will retain the same basic chemical structure as a naturally occurring amino acid.

An "amino acid mimetic" is a chemical compound that has a structure that is different from the general chemical structure of an amino acid, but that functions in a manner similar to a naturally occurring amino acid. Examples include a methacryloyl or acryloyl derivative of an amide, β-, γ-, δ-imino acids (such as piperidine-4-carboxylic acid) and the like.

A "non-naturally occurring amino acid" is a compound that has the same basic chemical structure as a naturally occurring amino acid, but is not incorporated into a growing polypeptide chain by the translation complex. "Non-naturally occurring amino acid" also includes, but is not limited to, amino acids that occur by modification (e.g., posttranslational modifications) of a naturally encoded amino acid (including but not limited to, the 20) common amino acids) but are not themselves naturally incorporated into a growing polypeptide chain by the translation complex. A non-limiting list of examples of non-naturally occurring amino acids that can be inserted into a polypeptide sequence or substituted for a wild-type residue in polypeptide sequence include β-amino acids, homoamino acids, cyclic amino acids and amino acids with derivatized side chains. Examples include (in the L-form or D-form; abbreviated as in parentheses); citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methyl-glutamine (NMeQ), norleucine (Nle), norvaline (Nva), 1,2,3,4-tetrahydroisoquinoline (Tic), Octahydroindole-2-carboxylic acid (Oic), 3-(1-naphthyl) alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K (glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Na-methylnorleucine (NMeNle), cyclopentylglycine (Cpg), cyclohexylglycine (Chg), acetylarginine (acetylarg), α,β-diaminopropionoic acid (Dpr), α,γ-diaminobutyric acid (Dab), diaminopropionic acid (Dap), cyclohexylalanine (Cha), 4-methyl-phenylalanine (MePhe), β,β-diphenyl-alanine (BiPhA), aminobutyric acid (Abu), 4-phenyl-phenylalanine (or biphenylalanine: 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

The term "isolated nucleic acid molecule" refers to a single or double-stranded polymer of deoxyribonucleotide or ribonucleotide bases read from the 5' to the 3' end (e.g., a GIPR nucleic acid sequence provided herein), or an analog thereof, that has been separated from at least about 50 percent of polypeptides, peptides, lipids, carbohydrates, polynucleotides or other materials with which the nucleic acid is naturally found when total nucleic acid is isolated from the source cells. Preferably, an isolated nucleic acid molecule is substantially free from any other contaminating nucleic acid molecules or other molecules that are found in the natural environment of the nucleic acid that would interfere with its use in polypeptide production or its therapeutic, diagnostic, prophylactic or research use.

The term "isolated polypeptide" refers to a polypeptide (e.g., a GIPR polypeptide sequence provided herein or an antigen binding protein of the present invention) that has been separated from at least about 50 percent of polypeptides, peptides, lipids, carbohydrates, polynucleotides, or other materials with which the polypeptide is naturally found when isolated from a source cell. Preferably, the isolated polypeptide is substantially free from any other contaminating polypeptides or other contaminants that are found in its natural environment that would interfere with its therapeutic, diagnostic, prophylactic or research use.

A composition of the present invention that includes a GLP-1 receptor agonist of the present invention fused via a peptide bond of its C-terminus to the N-terminus of an anti-GIPR antigen binding protein of the invention or is a "fusion protein" or "fusion molecule", or simply "fusion" of the present invention. A peptide linker sequence may be interposed between the GLP-1 receptor agonist peptide and the anti-GIPR antigen binding protein such that the GLP-1 receptor agonist of the present invention is fused via a peptide bond of its C-terminus to the N-terminus of the linker peptide, and the C-terminus of the linker peptide is fused via a peptide bond to the N-terminus of the light chain variable region or to the N-terminus of the heavy chain variable region of the anti-GIPR antigen binding protein. Although the GLP-1 receptor agonists and/or linker peptides can be fused to the anti-GIPR antigen binding protein after translation or purification of the anti-GIPR antigen binding protein, in one embodiment the fusion proteins of the present invention can be produced via expression of the full length fusion protein in a suitable cell type without a further conjugation reaction.

The term "encoding" refers to a polynucleotide sequence encoding one or more amino acids. The term does not require a start or stop codon.

The terms "identical" and percent "identity," in the context of two or more nucleic acids or polypeptide sequences, refer to two or more sequences or subsequences that are the same. "Percent identity" means the percent of identical residues between the amino acids or nucleotides in the compared molecules and is calculated based on the size of the smallest of the molecules being compared. For these calculations, gaps in alignments (if any) can be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), (1988) New York: Oxford University Press: Biocomputing Informatics and Genome Projects, (Smith, D. W., ed.), 1993, New York: Academic Press: Computer Analysis of Sequence Data, Part I, (Griffin, A. M., and Griffin, H. G., eds.), 1994, New Jersey: Humana Press: von Heinje, G., (1987) Sequence Analysis in Molecular Biology, New York: Academic Press: Sequence Analysis Primer, (Gribskov, M, and Devereux, J., eds.), 1991, New York: M. Stockton Press; and Carillo et al., (1988) SIAM J. Applied Math. 48:1073.

In calculating percent identity, the sequences being compared are aligned in a way that gives the largest match between the sequences. The computer program used to determine percent identity is the GCG program package, which includes GAP (Devereux et al., (1984) Nucl. Acid Res. 12:387: Genetics Computer Group, University of Wisconsin, Madison, WI). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used: the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) Atlas of Protein Sequence and Structure 5:345-352 for the PAM 250 comparison matrix: Henikoff et al., (1992) Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, J. Mol. Biol. 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

The terms "GIPR polypeptide" and "GIPR protein" are used interchangeably and mean a naturally-occurring wild-type polypeptide expressed in a mammal, such as a human or a mouse, and includes naturally occurring alleles (e.g., naturally occurring allelic forms of human GIPR protein). For purposes of this disclosure, the term "GIPR polypeptide" can be used interchangeably to refer to any full-length GIPR polypeptide, e.g., SEQ ID NO: 3141, which consists of 466 amino acid residues and which is encoded by the nucleotide sequence SEQ ID NO: 3142, or SEQ ID NO: 3143, which consists of 430 amino acid residues and which is encoded by the nucleic acid sequence SEQ ID NO: 3144, or SEQ ID NO: 3145, which consists of 493 amino acid resides and which is encoded by the nucleic acid sequence of SEQ ID NO: 3146, or SEQ ID NO. 3147, which consists of 460 amino acids residues and which is encoded by the nucleic acid sequence of SEQ ID NO: 3148, or SEQ ID NO. 3149, which consists of 230 amino acids residues and which is encoded by the nucleic acid sequence of SEQ ID NO: 3150.

The term "GIPR polypeptide" also encompasses a GIPR polypeptide in which a naturally occurring GIPR polypeptide sequence (e.g., SEQ ID NOs: 3141, 3143 or 3145) has been modified. Such modifications include, but are not limited to, one or more amino acid substitutions, including substitutions with non-naturally occurring amino acids non-naturally-occurring amino acid analogs and amino acid mimetics.

In various embodiments, a GIPR polypeptide comprises an amino acid sequence that is at least about 85 percent identical to a naturally-occurring GIPR polypeptide (e.g., SEQ ID NOs: 3141, 3143 or 3145). In other embodiments, a GIPR polypeptide comprises an amino acid sequence that is at least about 90 percent, or about 95, 96, 97, 98, or 99 percent identical to a naturally-occurring GIPR polypeptide amino acid sequence (e.g., SEQ ID NOs: 3141, 3143 or 3145). Such GIPR polypeptides preferably, but need not, possess at least one activity of a wild-type GIPR polypeptide, such as the ability to bind GIP. The present invention also encompasses nucleic acid molecules encoding such GIPR polypeptide sequences.

The terms "GIPR activity assay" (also referred to as a "GIPR functional assay") means an assay that can be used to measure GIP or a GIP binding protein activity in a cellular setting. In one embodiment, the "activity" (or "functional") assay" can be a CAMP assay in GIPR expressing cells, in which GIP can induce cAMP signal, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426). In another embodiment, the "activity" (or "functional") assay can be an insulin secretion assay in pancreatic beta cells, in which GIP can induce glucose-dependent insulin secretion, and the activity of a GIP/GIPR binding protein could be measured in the presence/absence of GIP ligand, in which IC50/EC50 and degree of inhibition/activation can be obtained (Biochemical and Biophysical Research Communications (2002) 290:1420-1426).

The term "GIPR binding assay" means an assay that can be used to measure binding of GIP to GIPR. In one embodiment. "GIPR binding assay" can be an assay using FMAT or FACS that measures fluorescence-labeled GIP binding to GIPR expression cells, and GIP/GIPR binding protein's activity can be measured for displacing fluorescence-labeled GIP binding to GIPR expression cells. In another embodiment. "GIPR binding assay" can be an assay that measures radioactive-labeled GIP binding to GIPR expression cells, and GIP/GIPR binding protein's activity can be measured for displacing radioactive labeled GIP binding to GIPR expression cells (Biochimica et Biophysica Acta (2001) 1547:143-155). The terms "GIP". "Gastric inhibitory polypeptide", "glucose-dependent insulinotropic peptide" and "GIP ligand" are used interchangeably and mean a naturally-occurring wild-type polypeptide expressed in a mammal, such as a human or a mouse, and includes naturally occurring alleles (e.g., naturally occurring allelic forms of human GIP protein). For purposes of this disclosure, the term "GIP" can be used interchangeably to refer to any mature GIP polypeptide.

The 42 amino acid sequence of mature human GIP is:

```
                                            (SEQ ID NO: 3151)
YAEGTFISDY SIAMDKIHQQ DFVNWLLAQK GKKNDWKHNI TQ
```

and is encoded by the DNA sequence:

```
                                            (SEQ ID NO: 3152)
tatgcggaag gcacctttat tagcgattat agcattgcga

tggataaaat tcatcagcag gattttgtga actggctgct

ggcgcagaaa ggcaaaaaaa acgattggaa acataacatt

acccag.
```

The 42 amino acid sequence of mature murine GIP is:

```
                                            (SEQ ID NO: 3153)
YAEGTFISDY SIAMDKIRQQ DFVNWLLAQR GKKSDWKHNI TQ
```

and is encoded by the DNA sequence:

```
                                            (SEQ ID NO: 3154)
tatgcggaag gcacctttat tagcgattat agcattgcga

tggataaaat tcgccagcag gattttgtga actggctgct

ggcgcagcgc ggcaaaaaaa gcgattggaa acataacatt

acccag.
```

The 42 amino acid sequence of mature rat GIP is:

```
                                            (SEQ ID NO: 3155)
YAEGTFISDY SIAMDKIRQQ DFVNWLLAQK GKKNDWKHNL TQ
```

and is encoded by the DNA sequence:

```
                                         (SEQ ID NO: 3156)
tatgcggaag gcacctttat tagcgattat agcattgcga

tggataaaat tcgccagcag gattttgtga actggctgctg

gcgcagaaag gcaaaaaaaa cgattggaaa cataacctgac ccag.
```

An "antigen binding protein" as used herein means any protein that specifically binds a specified target antigen, such as a GIPR polypeptide (e.g., a human GIPR polypeptide such as provided in SEQ ID NOs: 3141, 3143 or 3145). The term encompasses intact antibodies that comprise at least two full-length heavy chains and two full-length light chains, as well as derivatives, variants, fragments, and mutations thereof. Examples of antibody fragments include Fab, Fab', $F(ab')_2$, and Fv fragments. An antigen binding protein also includes domain antibodies such as nanobodies and scFvs as described further below.

In general, a GIPR antigen binding protein is said to "specifically bind" its target antigen GIPR when the antigen binding protein exhibits essentially background binding to non-GIPR molecules. An antigen binding protein that specifically binds GIPR may, however, cross-react with GIPR polypeptides from different species. Typically, a GIPR antigen binding protein specifically binds human GIPR when the dissociation constant (KD) is $\leq 10^{-7}$ M as measured via a surface plasma resonance technique (e.g., BIACore, GE-Healthcare Uppsala, Sweden) or Kinetic Exclusion Assay (KinExA, Sapidyne, Boise, Idaho). A GIPR antigen binding protein specifically binds human GIPR with "high affinity" when the KD is $\leq 5\times10^{-9}$ M, and with "very high affinity" when the KD is $\leq 5\times10^{-10}$ M, as measured using methods described.

"Antigen binding region" means a protein, or a portion of a protein, that specifically binds a specified antigen. For example, that portion of an antigen binding protein that contains the amino acid residues that interact with an antigen and confer on the antigen binding protein its specificity and affinity for the antigen is referred to as "antigen binding region." An antigen binding region typically includes one or more "complementary binding regions" ("CDRs") of an immunoglobulin, single-chain immunoglobulin, or camelid antibody. Certain antigen binding regions also include one or more "framework" regions. A "CDR" is an amino acid sequence that contributes to antigen binding specificity and affinity. "Framework" regions can aid in maintaining the proper conformation of the CDRs to promote binding between the antigen binding region and an antigen.

A "recombinant protein", including a recombinant GIPR antigen binding protein, is a protein made using recombinant techniques, i.e., through the expression of a recombinant nucleic acid as described herein. Methods and techniques for the production of recombinant proteins are well known in the art.

The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" as such is a species of an antigen binding protein. An intact antibody generally will comprise at least two full-length heavy chains and two full-length light chains.

Antibodies may be derived solely from a single source, or may be "chimeric," that is, different portions of the antibody may be derived from two different antibodies as described further below. The antigen binding proteins, antibodies, or binding fragments may be produced in hybridomas, by recombinant DNA techniques, or by enzymatic or chemical cleavage of intact antibodies.

The term "light chain" as used with respect to an antibody or fragments thereof includes a full-length light chain and fragments thereof having sufficient variable region sequence to confer binding specificity. A full-length light chain includes a variable region domain, VL, and a constant region domain, CL. The variable region domain of the light chain is at the amino-terminus of the polypeptide. Light chains include kappa chains and lambda chains.

The term "heavy chain" as used with respect to an antibody or fragment thereof includes a full-length heavy chain and fragments thereof having sufficient variable region sequence to confer binding specificity. A full-length heavy chain includes a variable region domain, VH, and three constant region domains, CH1, CH2, and CH3. The VH domain is at the amino-terminus of the polypeptide, and the CH domains are at the carboxyl-terminus, with the CH3 being closest to the carboxy-terminus of the polypeptide. Heavy chains may be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope.

These biologically active fragments may be produced by recombinant DNA techniques, or may be produced by enzymatic or chemical cleavage of antigen binding proteins, including intact antibodies. Immunologically functional immunoglobulin fragments include, but are not limited to, Fab, Fab', and $F(ab')_2$ fragments.

In another embodiment, Fvs, domain antibodies and scFvs, and may be derived from an antibody of the present invention.

It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

A "Fab fragment" is comprised of one light chain and the CH1 and variable regions of one heavy chain. The heavy chain of a Fab molecule cannot form a disulfide bond with another heavy chain molecule.

An "Fc" region contains two heavy chain fragments comprising the CH2 and CH3 domains of an antibody. The two heavy chain fragments are held together by two or more disulfide bonds and by hydrophobic interactions of the CH3 domains.

An "Fab' fragment" contains one light chain and a portion of one heavy chain that contains the VH domain and the CH1 domain and also the region between the CH1 and CH2 domains, such that an interchain disulfide bond can be formed between the two heavy chains of two Fab' fragments to form an F(ab')2 molecule.

An "F(ab')2 fragment" contains two light chains and two heavy chains containing a portion of the constant region between the CH1 and CH2 domains, such that an interchain disulfide bond is formed between the two heavy chains. A F(ab')2 fragment thus is composed of two Fab' fragments that are held together by a disulfide bond between the two heavy chains.

The "Fv region" comprises the variable regions from both the heavy and light chains, but lacks the constant regions.

"Single chain antibodies" or "scFvs" are Fv molecules in which the heavy and light chain variable regions have been connected by a flexible linker to form a single polypeptide chain, which forms an antigen-binding region. scFvs are discussed in detail in International Patent Application Publication No. WO 88/01649 and U.S. Pat. Nos. 4,946,778 and 5,260,203, the disclosures of which are incorporated by reference.

A "domain antibody" or "single chain immunoglobulin" is an immunologically functional immunoglobulin fragment containing only the variable region of a heavy chain or the variable region of a light chain. Examples of domain antibodies include Nanobodies R. In some instances, two or more VH regions are covalently joined with a peptide linker to create a bivalent domain antibody. The two VH regions of a bivalent domain antibody may target the same or different antigens.

A "bivalent antigen binding protein" or "bivalent antibody" comprises two antigen binding regions. In some instances, the two binding regions have the same antigen specificities. Bivalent antigen binding proteins and bivalent antibodies may be bispecific, see, infra.

A multispecific antigen binding protein" or "multispecific antibody" is one that targets more than one antigen or epitope.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and may be produced by a variety of methods including, but not limited to, fusion of hybridomas or linking of Fab' fragments. See, e.g., Songsivilai and Lachmann, 1990, Clin. Exp. Immunol. 79:315-321: Kostelny et al., 1992. J. Immunol. 148:1547-1553. The two binding sites of a bispecific antigen binding protein or antibody will bind to two different epitopes, which may reside on the same or different protein targets.

The term "compete" when used in the context of antigen binding proteins (e.g., antibodies) means competition between antigen binding proteins is determined by an assay in which the antigen binding protein (e.g., antibody or immunologically functional fragment thereof) under test prevents or inhibits specific binding of a reference antigen binding protein to a common antigen (e.g., GIPR or a fragment thereof). Numerous types of competitive binding assays can be used, for example: solid phase direct or indirect radioimmunoassay (RIA), solid phase direct or indirect enzyme immunoassay (EIA), sandwich competition assay (see, e.g., Stahli et al., 1983, Methods in Enzymology 9:242-253); solid phase direct biotin-avidin EIA (see, e.g., Kirkland et al., 1986, J. Immunol. 137:3614-3619) solid phase direct labeled assay, solid phase direct labeled sandwich assay (see, e.g., Harlow and Lane, 1988, Antibodies, A Laboratory Manual, Cold Spring Harbor Press); solid phase direct label RIA using I-125 label (see, e.g., Morel et al., 1988, Molec. Immunol. 25:7-15); solid phase direct biotin-avidin EIA (see, e.g., Cheung, et al., 1990, Virology 176: 546-552); and direct labeled RIA (Moldenhauer et al., 1990, Scand. J. Immunol. 32:77-82). Typically, such an assay involves the use of purified antigen bound to a solid surface or cells bearing either of these, an unlabelled test antigen binding protein and a labeled reference antigen binding protein. Competitive inhibition is measured by determining the amount of label bound to the solid surface or cells in the presence of the test antigen binding protein. Usually the test antigen binding protein is present in excess. Additional details regarding methods for determining competitive binding are provided in the examples herein. Usually, when a competing antigen binding protein is present in excess, it will inhibit specific binding of a reference antigen binding protein to a common antigen by at least 40%, 45%, 50%, 55%, 60%, 65%, 70% or 75%. In some instances, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody), and additionally capable of being used in an animal to produce antibodies capable of binding to that antigen. An antigen may possess one or more epitopes that are capable of interacting with different antigen binding proteins, e.g., antibodies.

The term "epitope" is the portion of a molecule that is bound by an antigen binding protein (for example, an antibody). The term includes any determinant capable of specifically binding to an antigen binding protein, such as an antibody. An epitope can be contiguous or non-contiguous (discontinuous) (e.g., in a polypeptide, amino acid residues that are not contiguous to one another in the polypeptide sequence but that within in context of the molecule are bound by the antigen binding protein). A conformational epitope is an epitope that exists within the conformation of an active protein but is not present in a denatured protein. In certain embodiments, epitopes may be mimetic in that they comprise a three dimensional structure that is similar to an epitope used to generate the antigen binding protein, vet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antigen binding proteins specific for a particular target antigen will preferentially recognize an epitope on the target antigen in a complex mixture of proteins and/or macromolecules.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, 96%, 97%, 98%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The term "treating" refers to any indicia of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being.

The treatment or amelioration of symptoms can be based on objective or subjective parameters: including the results of a physical examination, neuropsychiatric exams, and/or a psychiatric evaluation. For example, certain methods presented herein successfully treat cardiovascular disease such as atherosclerosis by decreasing the incidence of cardiovascular disease, causing remission of cardiovascular disease and/or ameliorating a symptom associated with cardiovascular disease.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with the disease state (e.g., diabetes, obesity, dyslipidemia, elevated glucose levels, elevated insulin levels or diabetic nephropathy. In some embodiments, the effective amount is a therapeutically effective amount or a prophylactically effective amount. A "therapeutically effective amount" is an amount sufficient to remedy a disease state (e.g. atherosclerosis) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of the disease state, or reducing the likelihood of the onset (or reoccurrence) of the disease state or associated symptoms. The full therapeutic or prophylactic effect does not necessarily occur by administration of one dose, and may occur only after administration of a series of doses. Thus, a therapeutically or prophylactically effective amount may be administered in one or more administrations.

The terms "therapeutically effective dose" and "therapeutically effective amount," as used herein, means an amount of a GIPR binding protein that elicits a biological or medicinal response in a tissue system, animal, or human being sought by a researcher, physician, or other clinician, which includes alleviation or amelioration of the symptoms of the disease or disorder being treated, i.e., an amount of a GIPR binding protein that supports an observable level of one or more desired biological or medicinal response, for example lowering blood glucose, insulin, triglyceride, or cholesterol levels: reducing body weight: or improving glucose tolerance, energy expenditure, or insulin sensitivity.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. The modifications include base modifications such as bromouridine and inosine derivatives, ribose modifications such as 2,3-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including a radiolabel, a fluorescent label, a hapten or an antigenic label, for detection assays. Oligonucleotides may be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty other proteins or portions thereof, or may include operably linked regulatory sequences that control expression of the coding region of the recited nucleic acid sequences, and/or may include vector sequences.

Unless specified otherwise, the left-hand end of any single-stranded polynucleotide sequence discussed herein is the 5' end: the left-hand direction of double-stranded polynucleotide sequences is referred to as the 5' direction. The direction of 5' to 3' addition of nascent RNA transcripts is referred to as the transcription direction: sequence regions on the DNA strand having the same sequence as the RNA transcript that are 5' to the 5' end of the RNA transcript are referred to as "upstream sequences:" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences may depend upon the host organism. In particular embodiments, control sequences for prokaryotes may include a promoter, a ribosomal binding site, and a transcription termination sequence. For example, control sequences for eukaryotes may include promoters comprising one or a plurality of recognition sites for transcription factors, transcription enhancer sequences, and transcription termination sequences. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct may include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed with a nucleic acid sequence and thereby expresses a gene of interest. The term includes the progeny of the parent cell, whether or not the progeny is identical in morphology or in genetic make-up to the original parent cell, so long as the gene of interest is present.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell; or it is produced by a genetically-engineered or recombinant cell, and comprise molecules having the amino acid sequence of the native protein, or molecules having deletions from, additions to, and/or substitutions of one or more amino acids of the native sequence. The terms "polypeptide" and "protein" specifically encompass GIPR antigen binding proteins, antibodies, or sequences that have deletions from, additions to, and/or substitutions of one or more amino acids of an antigen-binding protein. The term "polypeptide fragment" refers to a polypeptide that has an amino-terminal deletion, a carboxyl-terminal deletion, and/or an internal deletion as compared with the full-length protein. Such fragments may also contain modified amino acids as compared with the full-length protein. In certain embodiments, fragments are about five to 500 amino acids long. For example, fragments may be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof may encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein such as an antibody) comprises an amino acid sequence wherein one or more amino acid residues are inserted into, deleted from and/or substituted into the amino acid sequence relative to another polypeptide sequence.

The term "naturally occurring" as used throughout the specification in connection with biological materials such as polypeptides, nucleic acids, host cells, and the like, refers to materials which are found in nature.

A "subject" or "patient" as used herein can be any mammal. In a typical embodiment, the subject or patient is a human.

As disclosed herein, a GIPR polypeptide described by the instant disclosure can be engineered and/or produced using standard molecular biology methodology. In various examples, a nucleic acid sequence encoding a GIPR, which can comprise all or a portion of SEQ ID NOs: 1, 3 or 5, can be isolated and/or amplified from genomic DNA, or cDNA using appropriate oligonucleotide primers. Primers can be designed based on the nucleic and amino acid sequences provided herein according to standard (RT)-PCR amplification techniques. The amplified GIPR nucleic acid can then be cloned into a suitable vector and characterized by DNA sequence analysis.

Oligonucleotides for use as probes in isolating or amplifying all or a portion of the GIPR sequences provided herein can be designed and generated using standard synthetic techniques, e.g., automated DNA synthesis apparatus, or can be isolated from a longer sequence of DNA.

The 466 amino acid sequence of human GIPR is (Volz et al., FEBS Lett. 373:23-29 (1995); NCBI Reference Sequence: NP_0001555):

```
                                      (SEQ ID NO: 3141)
MTTSPILQLL LRLSLCGLLL QRAETGSKGQ TAGELYQRWE
RYRRECQETL AAAEPPSGLA CNGSFDMYVC WDYAAPNATA
RASCPWYLPW HHHVAAGFVL RQCGSDGQWG LWRDHTQCEN
PEKNEAFLDQ RLILERLQVM YTVGYSLSLA TLLLALLILS
LFRRLHCTRN YIHINLFTSF MLRAAAILSR DRLLPRPGPY
LGDQALALWN QALAACRTAQ IVTQYCVGAN YTWLLVEGVY
LHSLLVLVGG SEEGHFRYYL LLGWGAPALF VIPWVIVRYL
YENTQCWERN EVKAIWWIIR TPILMTILIN FLIFIRILGI
LLSKLRTRQM RCRDYRLRLA RSTLTLVPLL GVHEVVFAPV
TEEQARGALR FAKLGFEIFL SSFQGFLVSV LYCFINKEVQ
SEIRRGWHHC RLRRSLGEEQ RQLPERAFRA LPSGSGPGEV
PTSRGLSSGT LPGPGNEASR ELESYC
```

and is encoded by the DNA sequence (NCBI Reference Sequence: NM_000164):

```
                                      (SEQ ID NO: 3142)
ggcagcggtg gcaggggctg caggagcaag tgaccaggag
caggactggg gacaggcctg atcgcccctg cacgaaccag
acccttcgcc gccctcacga tgactacctc tccgatcctg
cagctgctgc tgcggctctc actgtgcggg ctgctgctcc
agagggcgga gacaggctct aaggggcaga cggcggggga
gctgtaccag cgctgggaac ggtaccgcag ggagtgccag
gagaccttgg cagccgcgga accgccttca ggcctcgcct
gtaacgggtc cttcgatatg tacgtctgct gggactatgc
tgcacccaat gccactgccc gtgcgtcctg cccctggtac
ctgccctggc accaccatgt ggctgcaggt ttcgtcctcc
```

-continued

```
gccagtgtgg cagtgatggc caatggggac tttggagaga
ccatacacaa tgtgagaacc cagagaagaa tgaggccttt
ctggaccaaa ggctcatctt ggagcggttg caggtcatgt
acactgtcgg ctactccctg tctctcgcca cactgctgct
agccctgctc atcttgagtt tgttcaggcg gctacattgc
actagaaact atatccacat caacctgttc acgtctttca
tgctgcgagc tgcggccatt ctcagccgag accgtctgct
acctcgacct ggcccctacc ttggggacca ggcccttgcg
ctgtggaacc aggccctcgc tgcctgccgc acggcccaga
tcgtgaccca gtactgcgtg ggtgccaact acacgtggct
gctggtggag ggcgtctacc tgcacagtct cctggtgctc
gtgggaggct ccgaggaggg ccacttccgc tactacctgc
tcctcggctg gggggccccc gcgcttttcg tcattccctg
ggtgatcgtc aggtacctgt acgagaacac gcagtgctgg
gagcgcaacg aagtcaaggc catttggtgg attatacgga
cccccatcct catgaccatc ttgattaatt tcctcatttt
tatccgcatt cttggcattc tcctgtccaa gctgaggaca
cggcaaatgc gctgccggga ttaccggctg aggctggctc
gctccacgct gacgctggtg cccctgctgg gtgtccacga
ggtggtgttt gctcccgtga cagaggaaca ggcccggggc
gccctgcgct tcgccaagct cggctttgag atcttcctca
gctccttcca gggcttcctg gtcagcgtcc tctactgctt
catcaacaag gaggtgcagt cggagatccg ccgtggctgg
caccactgcc gcctgcgccg cagcctgggc gaggagcaac
gccagctccc ggagcgcgcc ttccgggccc tgccctccgg
ctccggcccg ggcgaggtcc ccaccagccg cggcttgtcc
tcggggaccc tcccagggcc tgggaatgag gccagccggg
agttggaaag ttactgctag gggcgggat ccccgtgtct
gttcagttag catggattta ttgagtgcca actgcgtgcc
aggcccagta cggaggacgc tggggaaatg gtgaaggaaa
cagaaaaaag gtccctgccc ttctggagat gacaactgag
tggggaaaac agaccgtgaa cacaaaacat caagttccac
acacgctatg gaatggttat gaagggaagc gagaaggggg
cctagggtgg tctgggaggc gtctccaagg aggtgacact
taagccatcc ccgaaagagg tgaaagagat cactttgggg
agagctggag aacaggattc taggcggaag cgatagcata
ggcaaaggcc cttgggcagg aaggcgctca gccttggctg
gagtagaatt aagtcagagc caacaggtgg ggagagacag
agaagtgggc aggggcaccc aagttgggat ttcatttcag
gtgcattgga gattcttagg agtgtctctt gggggtaata
ttttattttt taaaaaatga ggat.
```

A 430 amino acid isoform of human GIPR (isoform X1), predicted by automated computational analysis, has the sequence (NCBI Reference Sequence XP_005258790):

(SEQ ID NO: 3143)

```
MTTSPILQLL LRLSLCGLLL QRAETGSKGQ TAGELYQRWE
RYRRECQETL AAAEPPSVAA GFVLRQCGSD GQWGLWRDHT
QCENPEKNEA FLDQRLILER LQVMYTVGYS LSLATLLLAL
LILSLFRRLH CTRNYIHINL FTSFMLRAAA ILSRDRLLPR
PGPYLGDQAL ALWNQALAAC RTAQIVTQYC VGANYTWLLV
EGVYLHSLLV LVGGSEEGHF RYYLLLGWGA PALFVIPWVI
VRYLYENTQC WERNEVKAIW WIIRTPILMT ILINFLIFIR
ILGILLSKLR TRQMRCRDYR LRLARSTLTL VPLLGVHEVV
FAPVTEEQAR GALRFAKLGF EIFLSSFQGF LVSVLYCFIN
KEVQSEIRRG WHHCRLRRSL GEEQRQLPER AFRALPSGSG
PGEVPTSRGL SSGTLPGPGN EASRELESYC
```

and is encoded by the DNA sequence:

(SEQ ID NO: 3144)

```
atgaccacca gcccgattct gcagctgctg ctgcgcctga
gcctgtgcgg cctgctgctg cagcgcgcgg aaaccggcag
caaaggccag accgcgggcg aactgtatca gcgctgggaa
cgctatcgcc gcgaatgcca ggaaaccctg gcggcggcgg
aaccgccgag cgtggcggcg ggctttgtgc tgcgccagtg
cggcagcgat ggccagtggg gcctgtggcg cgatcatacc
cagtgcgaaa acccggaaaa aaacgaagcg tttctggatc
agcgcctgat tctggaacgc ctgcaggtga tgtataccgt
gggctatagc ctgagcctgg cgaccctgct gctggcgctg
ctgattctga gcctgtttcg ccgcctgcat tgcacccgca
actatattca tattaacctg tttaccagct ttatgctgcg
cgcggcggcg attctgagcc gcgatcgcct gctgccgcgc
ccgggcccgt atctgggcga tcaggcgctg gcgctgtgga
accaggcgct ggcggcgtgc cgcaccgcgc agattgtgac
ccagtattgc gtgggcgcga actatacctg gctgctggtg
gaaggcgtgt atctgcatag cctgctggtg ctggtgggcg
gcagcgaaga aggccatttt cgctattatc tgctgctggg
ctggggcgcg ccggcgctgt ttgtgattcc gtgggtgatt
gtgcgctatc tgtatgaaaa cacccagtgc tgggaacgca
acgaagtgaa agcgatttgg tggattattc gcaccccgat
tctgatgacc attctgatta actttctgat ttttattcgc
attctgggca ttctgctgag caaactgcgc acccgccaga
tgcgctgccg cgattatcgc ctgcgcctgg cgcgcagcac
cctgaccctg gtgccgctgc tgggcgtgca tgaagtggtg
```

-continued tttgcgccgg tgaccgaaga acaggcgcgc ggcgcgctgc
gctttgcgaa actgggcttt gaaatttttc tgagcagctt
tcagggcttt ctggtgagcg tgctgtattg ctttattaac
aaagaagtgc agagcgaaat tcgccgcggc tggcatcatt
gccgcctgcg ccgcagcctg ggcgaagaac agcgccagct
gccggaacgc gcgtttcgcg cgctgccgag cggcagcggc
ccgggcgaag tgccgaccag ccgcggcctg agcagcggca
ccctgccggg cccgggcaac gaagcgagcc gcgaactgga
aagctattgc.

A 493 amino acid isoform of human GIPR, produced by alternative splicing, has the sequence (Gremlich et al., Diabetes 44:1202-8 (1995); UniProtKB Sequence Identifier: P48546-2):

(SEQ ID NO: 3145)

MTTSPILQLL LRLSLCGLLL QRAETGSKGQ TAGELYQRWE
RYRRECQETL AAAEPPSGLA CNGSFDMYVC WDYAAPNATA
RASCPWYLPW HHHVAAGFVL RQCGSDGQWG LWRDHTQCEN
PEKNEAFLDQ RLILERLQVM YTVGYSLSLA TLLLALLILS
LFRRLHCTRN YIHINLFTSF MLRAAAILSR DRLLPRPGPY
LGDQALALWN QALAACRTAQ IVTQYCVGAN YTWLLVEGVY
LHSLLVLVGG SEEGHFRYYL LLGWGAPALF VIPWVIVRYL
YENTQCWERN EVKAIWWIIR TPILMTILIN FLIFIRILGI
LLSKLRTRQM RCRDYRLRLA RSTLTLVPLL GVHEVVFAPV
TEEQARGALR FAKLGFEIFL SSFQGFLVSV LYCFINKEVG
RDPAAAPALW RRRGTAPPLS AIVSQVQSEI RRGWHHCRLR
RSLGEEQRQL PERAFRALPS GSGPGEVPTS RGLSSGTLPG
PGNEASRELE SYC and is encoded by the DNA sequence:

(SEQ ID NO: 3146)

atgaccacca gcccgattct gcagctgctg ctgcgcctga
gcctgtgcgg cctgctgctg cagcgcgcgg aaaccggcag
caaaggccag accgcgggcg aactgtatca gcgctgggaa
cgctatcgcc gcgaatgcca ggaaaccctg gcggcggcgg
aaccgccgag cggcctggcg tgcaacggca gctttgatat
gtatgtgtgc tgggattatg cggcgccgaa cgcgaccgcg
cgcgcgagct gcccgtggta tctgccgtgg catcatcatg
tggcggcggg ctttgtgctg cgccagtgcg gcagcgatgg
ccagtggggc ctgtggcgcg atcataccca gtgcgaaaac
ccggaaaaaa acgaagcgtt tctggatcag cgcctgattc
tggaacgcct gcaggtgatg tataccgtgg gctatagcct
gagcctggcg accctgctgc tggcgctgct gattctgagc
ctgtttcgcc gcctgcattg cacccgcaac tatattcata
ttaacctgtt taccagcttt atgctgcgcg cggcggcgat
tctgagccgc gatcgcctgc tgccgcgccc gggcccgtat
ctgggcgatc aggcgctggc gctgtggaac caggcgctgg
cggcgtgccg caccgcgcag attgtgaccc agtattgcgt
gggcgcgaac tatacctggc tgctggtgga aggcgtgtat
ctgcatagcc tgctggtgct ggtgggcggc agcgaagaag
gccattttcg ctattatctg ctgctgggct ggggcgcgcc
ggcgctgttt gtgattccgt gggtgattgt gcgctatctg
tatgaaaaca cccagtgctg ggaacgcaac gaagtgaaag
cgatttggtg gattattcgc accccgattc tgatgaccat
tctgattaac tttctgattt ttattcgcat tctgggcatt
ctgctgagca aactgcgcac ccgccagatg cgctgccgcg
attatcgcct gcgcctggcg cgcagcaccc tgaccctggt
gccgctgctg ggcgtgcatg aagtggtgtt tgcgccggtg
accgaagaac aggcgcgcgg cgcgctgcgc tttgcgaaac
tgggctttga aatttttctg agcagctttc agggctttct
ggtgagcgtg ctgtattgct ttattaacaa agaagtgggc
cgcgatccgg cggcggcgcc ggcgctgtgg cgccgccgcg
gcaccgcgcc gccgctgagc gcgattgtga gccaggtgca
gagcgaaatt cgccgcggct ggcatcattg ccgcctgcgc
cgcagcctgg gcgaagaaca gcgccagctg ccggaacgcg
cgtttcgcgc gctgccgagc ggcagcggcc cgggcgaagt
gccgaccagc cgcggcctga gcagcggcac cctgccgggc
ccgggcaacg aagcgagccg cgaactggaa agctattgct aa The 460 amino acid sequence of murine GIPR is (NCBI Reference Sequence: NP_001074284; uniprotKB/Swiss-Prot QOP543-1); see Vassilatis et al., PNAS USA 2003, 100:4903-4908.

(SEQ ID NO: 3147)

MPLRLLLLLL WLWGLQWAET DSEGQTTTGE LYQRWEHYGQ
ECQKMLETTE PPSGLACNGS FDMYACWNYT AANTTARVSC
PWYLPWFRQV SAGFVFRQCG SDGQWGSWRD HTQCENPEKN
GAFQDQTLIL ERLQIMYTVG YSLSLTTLLL ALLILSLFRR
LHCTRNYIHM NLFTSFMLRA AAILTRDQLL PPLGPYTGDQ
APTPWNQALA ACRTAQIMTQ YCVGANYTWL LVEGVYLHHL
LVIVGRSEKG HFRCYLLLGW GAPALFVIPW VIVRYLRENT
QCWERNEVKA IWWIIRTPIL ITILINFLIF IRILGILVSK
LRTRQMRCPD YRLRLARSTL TLVPLLGVHE VVFAPVTEEQ
VEGSLRFAKL AFEIFLSSFQ GFLVSVLYCFINKEVQSEIRQ
GWRHRRLRLS LQEQRPRPHQ ELAPRAVPLS SACREAAVGN
ALPSGMLHVP GDEVLESYC and is encoded by the DNA sequence (NCBI Reference Sequence: NM_001080815):

(SEQ ID NO: 3148)

```
atgccgctgc gcctgctgct gctgctgctg tggctgtggg
gcctgcagtg ggcggaaacc gatagcgaag gccagaccac
caccggcgaa ctgtatcagc gctgggaaca ttatggccag
gaatgccaga aaatgctgga aaccaccgaa ccgccgagcg
gcctggcgtg caacggcagc tttgatatgt atgcgtgctg
gaactatacc gcggcgaaca ccaccgcgcg cgtgagctgc
ccgtggtatc tgccgtggtt tcgccaggtg agcgcgggct
ttgtgtttcg ccagtgcggc agcgatggcc agtggggcag
ctggcgcgat catacccagt gcgaaaaccc ggaaaaaaac
ggcgcgtttc aggatcagac cctgattctg gaacgcctgc
agattatgta taccgtgggc tatagcctga gcctgaccac
cctgctgctg gcgctgctga ttctgagcct gtttcgccgc
ctgcattgca cccgcaacta tattcatatg aacctgttta
ccagctttat gctgcgcgcg gcggcgattc tgacccgcga
tcagctgctg ccgccgctgg gcccgtatac cggcgatcag
gcgccgaccc cgtggaacca ggcgctggcg gcgtgccgca
ccgcgcagat tatgacccag tattgcgtgg gcgcgaacta
tacctggctg ctggtggaag gcgtgtatct gcatcatctg
ctggtgattg tgggccgcag cgaaaaaggc cattttcgct
gctatctgct gctgggctgg ggcgcgccgg cgctgtttgt
gattccgtgg gtgattgtgc gctatctgcg cgaaaacacc
cagtgctggg aacgcaacga agtgaaagcg atttggtgga
ttattcgcac cccgattctg attaccattc tgattaactt
tctgattttt attcgcattc tgggcattct ggtgagcaaa
ctgcgcaccc gccagatgcg ctgcccggat tatcgcctgc
gcctggcgcg cagcaccctg accctggtgc cgctgctggg
cgtgcatgaa gtggtgtttg cgccggtgac cgaagaacag
gtggaaggca gcctgcgctt tgcgaaactg gcgtttgaaa
tttttctgag cagctttcag ggctttctgg tgagcgtgct
gtattgcttt attaacaaag aagtgcagag cgaaattcgc
cagggctggc gccatcgccg cctgcgcctg agcctgcagg
aacagcgccc gcgcccgcat caggaactgg cgccgcgcgc
ggtgccgctg agcagcgcgt gccgcgaagc ggcggtgggc
aacgcgctgc cgagcggcat gctgcatgtg ccgggcgatg
aagtgctgga aagctattgc taa
```

A 230 amino acid isoform of murine GIPR, produced by alternative splicing, has the sequence (Gerhard et al., Genome Res, 14:2121-2127 (2004); NCBI Reference Sequence: AAI20674):

(SEQ ID NO: 3149)

```
MPLRLLLLLL WLWGLQWAET DSEGQTTTGE LYQRWEHYGQ
ECQKMLETTE PPSGLACNGS FDMYACWNYT AANTTARVSC
PWYLPWFRQV SAGFVFRQCG SDGQWGSWRD HTQCENPEKN
GAFQDQTLIL ERLQIMYTVG YSLSLTTLLL ALLILSLFRR
LHCTRNYIHM NLFTSFMLRA AAILTRDQLL PPLGPYTGDQ
APTPWNQVLH RLLPGGTKTF PIYFRTFPHH
```

and is encoded by the DNA sequence:

(SEQ ID NO: 3150)

```
atgccgctgc gcctgctgct gctgctgctg tggctgtggg
gcctgcagtg ggcggaaacc gatagcgaag gccagaccac
caccggcgaa ctgtatcagc gctgggaaca ttatggccag
gaatgccaga aaatgctgga aaccaccgaa ccgccgagcg
gcctggcgtg caacggcagc tttgatatgt atgcgtgctg
gaactatacc gcggcgaaca ccaccgcgcg cgtgagctgc
ccgtggtatc tgccgtggtt tcgccaggtg agcgcgggct
ttgtgtttcg ccagtgcggc agcgatggcc agtggggcag
ctggcgcgat catacccagt gcgaaaaccc ggaaaaaaac
ggcgcgtttc aggatcagac cctgattctg gaacgcctgc
agattatgta taccgtgggc tatagcctga gcctgaccac
cctgctgctg gcgctgctga ttctgagcct gtttcgccgc
ctgcattgca cccgcaacta tattcatatg aacctgttta
ccagctttat gctgcgcgcg gcggcgattc tgacccgcga
tcagctgctg ccgccgctgg gcccgtatac cggcgatcag
gcgccgaccc cgtggaacca ggtgctgcat cgcctgctgc
cgggcggcac caaaaccttt ccgatttatt ttcgcacctt
tccgcatcat taa.
```

As stated herein, the term "GIPR polypeptide" encompasses naturally occurring GIPR polypeptide sequences, e.g., human amino acid sequences SEQ ID NOs: 3141, 3143 or 3145. The term "GIPR polypeptide," however, also encompasses polypeptides comprising an amino acid sequence that differs from the amino acid sequence of a naturally occurring GIPR polypeptide sequence, e.g., SEQ ID NOs: 3141, 3143 or 3145, by one or more amino acids, such that the sequence is at least 85% identical to SEQ ID NOs: 3141, 3143 or 3145. GIPR polypeptides can be generated by introducing one or more amino acid substitutions, either conservative or non-conservative and using naturally or non-naturally occurring amino acids, at particular positions of the GIPR polypeptide.

A "conservative amino acid substitution" can involve a substitution of a native amino acid residue (i.e., a residue found in a given position of the wild-type GIPR polypeptide sequence) with a nonnative residue (i.e., a residue that is not found in a given position of the wild-type GIPR polypeptide sequence) such that there is little or no effect on the polarity or charge of the amino acid residue at that position. Conservative amino acid substitutions also encompass non-naturally occurring amino acid residues that are typically incorporated by chemical peptide synthesis rather than by synthesis in biological systems. These include peptidomimetics, and other reversed or inverted forms of amino acid moieties.

Naturally occurring residues can be divided into classes based on common side chain properties:

(1) hydrophobic: norleucine, Met, Ala, Val, Leu, Ile;
(2) neutral hydrophilic: Cys, Ser, Thr;
(3) acidic: Asp, Glu;
(4) basic: Asn, Gln, His, Lys, Arg;
(5) residues that influence chain orientation: Gly, Pro; and
(6) aromatic: Trp, Tyr, Phe.

Additional groups of amino acids can also be formulated using the principles described in, e.g., Creighton (1984) PROTEINS: STRUCTURE AND MOLECULAR PROPERTIES (2d Ed. 1993), W.H. Freeman and Company. In some instances it can be useful to further characterize substitutions based on two or more of such features (e.g., substitution with a "small polar" residue, such as a Thr residue, can represent a highly conservative substitution in an appropriate context).

Conservative substitutions can involve the exchange of a member of one of these classes for another member of the same class. Non-conservative substitutions can involve the exchange of a member of one of these classes for a member from another class.

Synthetic, rare, or modified amino acid residues having known similar physiochemical properties to those of an above-described grouping can be used as a "conservative" substitute for a particular amino acid residue in a sequence. For example, a D-Arg residue may serve as a substitute for a typical L-Arg residue. It also can be the case that a particular substitution can be described in terms of two or more of the above described classes (e.g., a substitution with a small and hydrophobic residue means substituting one amino acid with a residue(s) that is found in both of the above-described classes or other synthetic, rare, or modified residues that are known in the art to have similar physiochemical properties to such residues meeting both definitions).

Nucleic acid sequences encoding a GIPR polypeptide provided herein, including those degenerate to SEQ ID NOs: 3141, 3143 or 3145, and those encoding polypeptide variants of SEQ ID NOs: 3141, 3143 or 3145 form other aspects of the instant disclosure.

In order to express the GIPR nucleic acid sequences provided herein, the appropriate coding sequences, e.g., SEQ ID NOs: 3141, 3143 or 3145, can be cloned into a suitable vector and after introduction in a suitable host, the sequence can be expressed to produce the encoded polypeptide according to standard cloning and expression techniques, which are known in the art (e.g., as described in Sambrook, J., Fritsh, E. F., and Maniatis, T. Molecular Cloning: A Laboratory Manual 2nd, ed., Cold Spring Harbor Laboratory, Cold Spring Harbor Laboratory Press, Cold Spring Harbor, N.Y., 1989). The invention also relates to such vectors comprising a nucleic acid sequence according to the invention.

A "vector" refers to a delivery vehicle that (a) promotes the expression of a polypeptide-encoding nucleic acid sequence: (b) promotes the production of the polypeptide therefrom: (c) promotes the transfection/transformation of target cells therewith: (d) promotes the replication of the nucleic acid sequence: (e) promotes stability of the nucleic acid: (f) promotes detection of the nucleic acid and/or transformed/transfected cells; and/or (g) otherwise imparts advantageous biological and/or physiochemical function to the polypeptide-encoding nucleic acid. A vector can be any suitable vector, including chromosomal, non-chromosomal, and synthetic nucleic acid vectors (a nucleic acid sequence comprising a suitable set of expression control elements). Examples of such vectors include derivatives of SV40, bacterial plasmids, phage DNA, baculovirus, yeast plasmids, vectors derived from combinations of plasmids and phage DNA, and viral nucleic acid (RNA or DNA) vectors.

A recombinant expression vector can be designed for expression of a GIPR protein in prokaryotic (e.g., *E. coli*) or eukaryotic cells (e.g., insect cells, using baculovirus expression vectors, yeast cells, or mammalian cells). In one embodiment the host cell is a mammalian, non-human host cell. Representative host cells include those hosts typically used for cloning and expression, including *Escherichia coli* strains TOP10F', TOP10, DH10B, DH5a, HB101, W3110, BL21 (DE3) and BL21 (DE3) pLysS, BLUESCRIPT (Stratagene), mammalian cell lines CHO, CHO-K1, HEK293, 293-EBNA pIN vectors (Van Heeke & Schuster, J. Biol. Chem. 264:5503-5509 (1989); pET vectors (Novagen, Madison Wis.). Alternatively, the recombinant expression vector can be transcribed and translated in vitro, for example using T7 promoter regulatory sequences and T7 polymerase and an in vitro translation system. Preferably, the vector contains a promoter upstream of the cloning site containing the nucleic acid sequence encoding the polypeptide. Examples of promoters, which can be switched on and off, include the lac promoter, the T7 promoter, the trc promoter, the tac promoter and the trp promoter.

Thus, provided herein are vectors comprising a nucleic acid sequence encoding GIPR that facilitate the expression of recombinant GIPR. In various embodiments, the vectors comprise an operably linked nucleotide sequence which regulates the expression of GIPR. A vector can comprise or be associated with any suitable promoter, enhancer, and other expression-facilitating elements. Examples of such elements include strong expression promoters (e.g., a human CMV IE promoter/enhancer, an RSV promoter, SV40 promoter, SL3-3 promoter, MMTV promoter, or HIV LTR promoter, EF1alpha promoter, CAG promoter), effective poly(A) termination sequences, an origin of replication for plasmid product in *E. coli*, an antibiotic resistance gene as a selectable marker, and/or a convenient cloning site (e.g., a polylinker). Vectors also can comprise an inducible promoter as opposed to a constitutive promoter such as CMV IE. In one aspect, a nucleic acid comprising a sequence encoding a GIPR polypeptide which is operatively linked to a tissue specific promoter which promotes expression of the sequence in a metabolically-relevant tissue, such as liver or pancreatic tissue is provided.

In another aspect of the instant disclosure, host cells comprising the GIPR nucleic acids and vectors disclosed herein are provided. In various embodiments, the vector or nucleic acid is integrated into the host cell genome, which in other embodiments the vector or nucleic acid is extra-chromosomal.

Recombinant cells, such as yeast, bacterial (e.g., *E. coli*), and mammalian cells (e.g., immortalized mammalian cells) comprising such a nucleic acid, vector, or combinations of either or both thereof are provided. In various embodiments cells comprising a non-integrated nucleic acid, such as a plasmid, cosmid, phagemid, or linear expression element, which comprises a sequence coding for expression of a GIPR polypeptide, are provided.

A vector comprising a nucleic acid sequence encoding a GIPR polypeptide provided herein can be introduced into a host cell by transformation or by transfection. Methods of transforming a cell with an expression vector are well known.

A GIPR-encoding nucleic acid can be positioned in and/or delivered to a host cell or host animal via a viral vector. Any suitable viral vector can be used in this capacity. A viral vector can comprise any number of viral polynucleotides, alone or in combination with one or more viral proteins, which facilitate delivery, replication, and/or expression of the nucleic acid of the invention in a desired host cell. The viral vector can be a polynucleotide comprising all or part of a viral genome, a viral protein/nucleic acid conjugate, a virus-like particle (VLP), or an intact virus particle comprising viral nucleic acids and a GIPR polypeptide-encoding nucleic acid. A viral particle viral vector can comprise a wild-type viral particle or a modified viral particle. The viral vector can be a vector which requires the presence of another vector or wild-type virus for replication and/or expression (e.g., a viral vector can be a helper-dependent virus), such as an adenoviral vector amplicon. Typically, such viral vectors consist of a wild-type viral particle, or a viral particle modified in its protein and/or nucleic acid content to increase transgene capacity or aid in transfection and/or expression of the nucleic acid (examples of such vectors include the herpes virus/AAV amplicons). Typically, a viral vector is similar to and/or derived from a virus that normally infects humans. Suitable viral vector particles in this respect, include, for example, adenoviral vector particles (including any virus of or derived from a virus of the adenoviridae), adeno-associated viral vector particles (AAV vector particles) or other parvoviruses and parvoviral vector particles, papillomaviral vector particles, flaviviral vectors, alphaviral vectors, herpes viral vectors, pox virus vectors, retroviral vectors, including lentiviral vectors.

A GIPR polypeptide expressed as described herein can be isolated using standard protein purification methods. A GIPR polypeptide can be isolated from a cell in which is it naturally expressed or it can be isolated from a cell that has been engineered to express GIPR, for example a cell that does not naturally express GIPR.

Protein purification methods that can be employed to isolate a GIPR polypeptide, as well as associated materials and reagents, are known in the art. Additional purification methods that may be useful for isolating a GIPR polypeptide can be found in references such as Bootcov M R, 1997. Proc. Natl. Acad. Sci. USA 94:11514-9, Fairlie W D, 2000, Gene 254:67-76.

Antagonist antigen binding proteins that bind GIPR, including human GIPR (hGIPR) are provided herein. In one embodiment, the human GIPR has the sequence as such as set forth in SEQ ID NO: 3141. In another embodiment, the human GIPR has the sequence as such set forth in SEQ ID NO: 3143. In another embodiment, the human GIPR has the sequence as such set forth in SEQ ID NO: 3145.

The antigen binding proteins provided are polypeptides into which one or more complementary determining regions (CDRs), as described herein, are embedded and/or joined. In some antigen binding proteins, the CDRs are embedded into a "framework" region, which orients the CDR(s) such that the proper antigen binding properties of the CDR(s) are achieved. Certain antigen binding proteins described herein are antibodies or are derived from antibodies. In other antigen binding proteins, the CDR sequences are embedded in a different type of protein scaffold. The various structures are further described below.

The antigen binding proteins that are disclosed herein have a variety of utilities. The antigen binding proteins, for instance, are useful in specific binding assays, affinity purification of GIPR, and in screening assays to identify other antagonists of GIPR activity. Other uses for the antigen binding proteins include, for example, diagnosis of GIPR-associated diseases or conditions and screening assays to determine the presence or absence of GIPR. Given that the antigen binding proteins that are provided are antagonists, the GIPR antigen binding proteins have value in therapeutic methods in which it is useful to reduce weight gain, even while maintaining or increasing food intake, increasing % fat mass and increasing % lean mass, improving glucose tolerance, decreasing insulin levels, decreasing cholesterol and triglyceride levels. Accordingly, the antigen binding proteins have utility in the treatment and prevention of diabetes, e.g., type 2 diabetes, obesity, dyslipidemia, elevated glucose levels or elevated insulin levels.

A variety of selective binding agents useful for modulating the activity of GIPR are provided. These agents include, for instance, antigen binding proteins that contain an antigen binding domain (e.g., scFvs, domain antibodies, and polypeptides with an antigen binding region) and specifically bind to a GIPR polypeptide, in particular human GIPR. Some of the agents, for example, are useful in enhancing the activity of GIPR, and can activate one or more activities associated with GIPR.

In general the antigen binding proteins that are provided typically comprise one or more CDRs as described herein (e.g., 1, 2, 3, 4, 5 or 6). In some instances, the antigen binding protein comprises (a) a polypeptide structure and (b) one or more CDRs that are inserted into and/or joined to the polypeptide structure. The polypeptide structure can take a variety of different forms. For example, it can be, or comprise, the framework of a naturally occurring antibody, or fragment or variant thereof, or may be completely synthetic in nature. Examples of various polypeptide structures are further described below.

In certain embodiments, the polypeptide structure of the antigen binding proteins is an antibody or is derived from an antibody. Accordingly, examples of certain antigen binding proteins that are provided include, but are not limited to, monoclonal antibodies, bispecific antibodies, minibodies, domain antibodies such as Nanobodies R, synthetic antibodies (sometimes referred to herein as "antibody mimetics"), chimeric antibodies, humanized antibodies, human antibodies, antibody fusions, and portions or fragments of each, respectively. In some instances, the antigen binding protein is an immunological fragment of a complete antibody (e.g., a Fab, a Fab', a F(ab')2). In other instances the antigen binding protein is a scFv that uses CDRs from an antibody of the present invention.

The antigen binding proteins as provided herein specifically bind to a human GIPR. In a specific embodiment, the antigen binding protein specifically binds to human GIPR comprising or consisting of the amino acid sequence of SEQ ID NO: 3141. In a specific embodiment, the antigen binding protein specifically binds to human GIPR comprising or consisting of the amino acid sequence of SEQ ID NO: 3143. In a specific embodiment, the antigen binding protein specifically binds to human GIPR comprising or consisting of the amino acid sequence of SEQ ID NO: 3145.

The antigen binding proteins that are provided are antagonists and typically have one, two, three, four, five, six, seven or all eight of the following characteristics:

(a) ability to prevent or reduce binding of GIP to GIPR, where the levels can be measured, for example, by the methods such as radioactive- or fluorescence-labeled ligand binding study, or by the methods described herein (e.g. cAMP assay or other functional assays). The decrease can be at least 10, 25, 50, 100% or more relative to the pre-treatment levels of SEQ ID NO: 3141, 3143 or 3145 under comparable conditions.

(b) ability to decrease blood glucose;

(c) ability to increase glucose tolerance;

(d) ability to increase insulin sensitivity;

(e) ability to decrease body weight or reduce body weight gain;

(f) ability to decrease fat mass or decrease inflammation in fat tissue;

(g) ability to decrease fasting insulin levels;

(h) ability to decrease circulating cholesterol levels;

(i) ability to decrease circulating triglyceride levels;

(j) ability to decrease liver steatosis or reduce triglyceride level in liver;

(k) decrease AST, ALT, and/or ALP levels.

In one embodiment, a GIPR antigen binding protein has one or more of the following activities:

(a) binds human GIPR such that KD is ≤200 nM, is ≤150 nM, is ≤100 nM, is ≤50 nM, is ≤10 nM, is ≤5 nM, is ≤2 nM, or is ≤1 nM, e.g., as measured via a surface plasma resonance or kinetic exclusion assay technique.

(b) has a half-life in human serum of at least 3 days;

Some antigen binding proteins that are provided have an on-rate (ka) for GIPR of at least $10^4$/M×seconds, at least 105/M×seconds, or at least 106/M×seconds as measured, for instance, as described below. Certain antigen binding proteins that are provided have a slow dissociation rate or off-rate. Some antigen binding proteins, for instance, have a kd (off-rate) of $1\times10^{-2}$ $s^{-1}$, or $1\times10^{-3}$ $s^{-1}$, or $1\times10^{-4}$ $s^{-1}$, or $1-10^{-5}$ $s^{-1}$. In certain embodiments, the antigen binding protein has a KD (equilibrium binding affinity) of less than 25 pM, 50 pM, 100 pM, 500 pM, 1 nM, 5 nM, 10 nM, 25 nM or 50 nM.

In another aspect, an antigen-binding protein is provided having a half-life of at least one day in vitro or in vivo (e.g., when administered to a human subject). In one embodiment, the antigen binding protein has a half-life of at least three days. In various other embodiments, the antigen binding protein has a half-life of 4, 5, 6, 7, 8, 9, 10, 15, 20, 25, 30, 40, 50, or 60 days or longer. In another embodiment, the antigen binding protein is derivatized or modified such that it has a longer half-life as compared to the underivatized or unmodified antibody. In another embodiment, the antigen binding protein contains point mutations to increase serum half-life. Further details regarding such mutant and derivatized forms are provided below.

Some of the antigen binding proteins that are provided have the structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains", each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa and lambda light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2. IgG3, and IgG4. IgM subtypes include IgM, and IgM2. IgA subtypes include IgA1 and IgA2. In humans, the IgA and IgD isotypes contain four heavy chains and four light chains: the IgG and IgE isotypes contain two heavy chains and two light chains; and the IgM isotype contains five heavy chains and five light chains. The heavy chain C region typically comprises one or more domains that may be responsible for effector function. The number of heavy chain constant region domains will depend on the isotype. IgG heavy chains, for example, each contain three C region domains known as CH1, CH2 and CH3. The antibodies that are provided can have any of these isotypes and subtypes. In certain embodiments, the GIPR antibody is of the IgG1, IgG2, or IgG4 subtype. The terms "GIPR antibody" and "anti-GIPR antibody" are used interchangeably throughout this application and figures. Both terms refer to an antibody that binds to GIPR.

In full-length light and heavy chains, the variable and constant regions are joined by a "J" region of about twelve or more amino acids, with the heavy chain also including a "D" region of about ten more amino acids. See, e.g. Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

For the antibodies provided herein, the variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope on GIPR. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, J. Mol. Biol. 196:901-917; Chothia et al., 1989, Nature 342:878-883.

The sequence information for specific antibodies prepared and identified as described in the Examples below is summarized in TABLE 1. Thus, in an embodiment, an antigen binding protein is an antibody with the CDR, variable domain and light and heavy chain sequences as specified in one of the rows of TABLE 1. SEQ ID NOs have been assigned to variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 1, SEQ ID NOs have also been assigned to polynucleotides encoding the variable light chain, variable heavy chain, light chain, heavy chain, CDRL1, CDRL2, CDRL3, CDRH1, CDRH2, and CDRH3 sequences of the antibodies and fragments thereof of the present invention and are shown in TABLE 2. The antigen binding proteins of the present invention can be identified by SEQ ID NO, but also by construct name (e.g., 2C2.005) or identifier number (e.g., iPS: 336175). The antigen binding proteins identified in Tables 1-5 below can be grouped into families based on construct name. For example, the "4B1 family" includes the constructs 4B1, 4B1.010, 4B1.011, 4B1.012, 4B1.013, 4B1.014, 4B1.015, and 4B1.016.

The various light chain and heavy chain variable regions provided herein are depicted in TABLE 3. Each of these variable regions may be attached to a heavy or light chain constant regions to form a complete antibody heavy and light chain, respectively. Furthermore, each of the so generated heavy and light chain sequences may be combined to form a complete antibody structure.

TABLE 1

| | | Amino acid SEQ ID NOs. | | | | | | | | | |
|---|---|---|---|---|---|---|---|---|---|---|---|
| Identifier | Construct | VL | VH | LC | HC | CDRL1 | CDRL2 | CDRL3 | CDRH1 | CDRH2 | CDRH3 |
| iPS: 336175 | 2C2.005 | 1 | 158 | 315 | 472 | 629 | 786 | 943 | 1100 | 1257 | 1414 |
| iPS: 335914 | 4B1 | 2 | 159 | 316 | 473 | 630 | 787 | 944 | 1101 | 1258 | 1415 |
| iPS: 335938 | 6H1 | 3 | 160 | 317 | 474 | 631 | 788 | 945 | 1102 | 1259 | 1416 |
| iPS: 335941 | 2F11 | 4 | 161 | 318 | 475 | 632 | 789 | 946 | 1103 | 1260 | 1417 |
| iPS: 335970 | 5C2 | 5 | 162 | 319 | 476 | 633 | 790 | 947 | 1104 | 1261 | 1418 |
| iPS: 335978 | 13H12 | 6 | 163 | 320 | 477 | 634 | 791 | 948 | 1105 | 1262 | 1419 |
| iPS: 335986 | 11C1 | 7 | 164 | 321 | 478 | 635 | 792 | 949 | 1106 | 1263 | 1420 |
| iPS: 335994 | 12H11 | 8 | 165 | 322 | 479 | 636 | 793 | 950 | 1107 | 1264 | 1421 |
| iPS: 336024 | 18E3 | 9 | 166 | 323 | 480 | 637 | 794 | 951 | 1108 | 1265 | 1422 |
| iPS: 336041 | 2G10_LC1 | 10 | 167 | 324 | 481 | 638 | 795 | 952 | 1109 | 1266 | 1423 |
| iPS: 336077 | 4H9.004 | 11 | 168 | 325 | 482 | 639 | 796 | 953 | 1110 | 1267 | 1424 |
| iPS: 336088 | 6A5.004 | 12 | 169 | 326 | 483 | 640 | 797 | 954 | 1111 | 1268 | 1425 |
| iPS: 336099 | 17H11.004 | 13 | 170 | 327 | 484 | 641 | 798 | 955 | 1112 | 1269 | 1426 |
| iPS: 359621 | 17H11.004.001 | 14 | 171 | 328 | 485 | 642 | 799 | 956 | 1113 | 1270 | 1427 |
| iPS: 359781 | 4H9.004.001 | 15 | 172 | 329 | 486 | 643 | 800 | 957 | 1114 | 1271 | 1428 |
| iPS: 360929 | 4H9.004.002 | 16 | 173 | 330 | 487 | 644 | 801 | 958 | 1115 | 1272 | 1429 |
| iPS: 360936 | 4H9.004.003 | 17 | 174 | 331 | 488 | 645 | 802 | 959 | 1116 | 1273 | 1430 |
| iPS: 360943 | 4H9.004.004 | 18 | 175 | 332 | 489 | 646 | 803 | 960 | 1117 | 1274 | 1431 |
| iPS: 360949 | 4H9.004.005 | 19 | 176 | 333 | 490 | 647 | 804 | 961 | 1118 | 1275 | 1432 |
| iPS: 359761 | 4H9.004.006 | 20 | 177 | 334 | 491 | 648 | 805 | 962 | 1119 | 1276 | 1433 |
| iPS: 360955 | 4B1.010 | 21 | 178 | 335 | 492 | 649 | 806 | 963 | 1120 | 1277 | 1434 |
| iPS: 360962 | 4B1.011 | 22 | 179 | 336 | 493 | 650 | 807 | 964 | 1121 | 1278 | 1435 |
| iPS: 360968 | 4B1.012 | 23 | 180 | 337 | 494 | 651 | 808 | 965 | 1122 | 1279 | 1436 |
| iPS: 360974 | 4B1.013 | 24 | 181 | 338 | 495 | 652 | 809 | 966 | 1123 | 1280 | 1437 |
| iPS: 360978 | 4B1.014 | 25 | 182 | 339 | 496 | 653 | 810 | 967 | 1124 | 1281 | 1438 |
| iPS: 359785 | 4B1.015 | 26 | 183 | 340 | 497 | 654 | 811 | 968 | 1125 | 1282 | 1439 |
| iPS: 360982 | 4B1.016 | 27 | 184 | 341 | 498 | 655 | 812 | 969 | 1126 | 1283 | 1440 |
| iPS: 335922 | 18F2 | 28 | 185 | 342 | 499 | 656 | 813 | 970 | 1127 | 1284 | 1441 |
| iPS: 360986 | 18F2.002 | 29 | 186 | 343 | 500 | 657 | 814 | 971 | 1128 | 1285 | 1442 |
| iPS: 360995 | 18F2.003 | 30 | 187 | 344 | 501 | 658 | 815 | 972 | 1129 | 1286 | 1443 |
| iPS: 360999 | 18F2.004 | 31 | 188 | 345 | 502 | 659 | 816 | 973 | 1130 | 1287 | 1444 |
| iPS: 361005 | 18F2.005 | 32 | 189 | 346 | 503 | 660 | 817 | 974 | 1131 | 1288 | 1445 |
| iPS: 361009 | 18F2.006 | 33 | 190 | 347 | 504 | 661 | 818 | 975 | 1132 | 1289 | 1446 |
| iPS: 361013 | 18F2.007 | 34 | 191 | 348 | 505 | 662 | 819 | 976 | 1133 | 1290 | 1447 |
| iPS: 361017 | 18F2.008 | 35 | 192 | 349 | 506 | 663 | 820 | 977 | 1134 | 1291 | 1448 |
| iPS: 361021 | 18F2.009 | 36 | 193 | 350 | 507 | 664 | 821 | 978 | 1135 | 1292 | 1449 |
| iPS: 361028 | 18F2.010 | 37 | 194 | 351 | 508 | 665 | 822 | 979 | 1136 | 1293 | 1450 |
| iPS: 360535 | 18F2.011 | 38 | 195 | 352 | 509 | 666 | 823 | 980 | 1137 | 1294 | 1451 |
| iPS: 361035 | 18F2.012 | 39 | 196 | 353 | 510 | 667 | 824 | 981 | 1138 | 1295 | 1452 |
| iPS: 359940 | 2F11.002 | 40 | 197 | 354 | 511 | 668 | 825 | 982 | 1139 | 1296 | 1453 |
| iPS: 361039 | 2F11.003 | 41 | 198 | 355 | 512 | 669 | 826 | 983 | 1140 | 1297 | 1454 |
| iPS: 361043 | 2F11.004 | 42 | 199 | 356 | 513 | 670 | 827 | 984 | 1141 | 1298 | 1455 |
| iPS: 361049 | 2F11.005 | 43 | 200 | 357 | 514 | 671 | 828 | 985 | 1142 | 1299 | 1456 |
| iPS: 361055 | 2F11.006 | 44 | 201 | 358 | 515 | 672 | 829 | 986 | 1143 | 1300 | 1457 |
| iPS: 361059 | 2F11.007 | 45 | 202 | 359 | 516 | 673 | 830 | 987 | 1144 | 1301 | 1458 |
| iPS: 361063 | 2F11.008 | 46 | 203 | 360 | 517 | 674 | 831 | 988 | 1145 | 1302 | 1459 |
| iPS: 359949 | 2F11.009 | 47 | 204 | 361 | 518 | 675 | 832 | 989 | 1146 | 1303 | 1460 |
| iPS: 359956 | 2F11.010 | 48 | 205 | 362 | 519 | 676 | 833 | 990 | 1147 | 1304 | 1461 |
| iPS: 359865 | 6H1.002 | 49 | 206 | 363 | 520 | 677 | 834 | 991 | 1148 | 1305 | 1462 |
| iPS: 359869 | 6H1.003 | 50 | 207 | 364 | 521 | 678 | 835 | 992 | 1149 | 1306 | 1463 |
| iPS: 359873 | 6H1.004 | 51 | 208 | 365 | 522 | 679 | 836 | 993 | 1150 | 1307 | 1464 |
| iPS: 359877 | 6H1.005 | 52 | 209 | 366 | 523 | 680 | 837 | 994 | 1151 | 1308 | 1465 |
| iPS: 361067 | 6H1.006 | 53 | 210 | 367 | 524 | 681 | 838 | 995 | 1152 | 1309 | 1466 |
| iPS: 361071 | 6H1.007 | 54 | 211 | 368 | 525 | 682 | 839 | 996 | 1153 | 1310 | 1467 |
| iPS: 361075 | 6H1.008 | 55 | 212 | 369 | 526 | 683 | 840 | 997 | 1154 | 1311 | 1468 |
| iPS: 361079 | 6A5.004.001 | 56 | 213 | 370 | 527 | 684 | 841 | 998 | 1155 | 1312 | 1469 |
| iPS: 361085 | 6A5.004.002 | 57 | 214 | 371 | 528 | 685 | 842 | 999 | 1156 | 1313 | 1470 |
| iPS: 361091 | 6A5.004.003 | 58 | 215 | 372 | 529 | 686 | 843 | 1000 | 1157 | 1314 | 1471 |
| iPS: 361095 | 6A5.004.004 | 59 | 216 | 373 | 530 | 687 | 844 | 1001 | 1158 | 1315 | 1472 |
| iPS: 361101 | 6A5.004.005 | 60 | 217 | 374 | 531 | 688 | 845 | 1002 | 1159 | 1316 | 1473 |
| iPS: 361105 | 6A5.004.006 | 61 | 218 | 375 | 532 | 689 | 846 | 1003 | 1160 | 1317 | 1474 |
| iPS: 361109 | 6A5.004.007 | 62 | 219 | 376 | 533 | 690 | 847 | 1004 | 1161 | 1318 | 1475 |
| iPS: 361113 | 6A5.004.008 | 63 | 220 | 377 | 534 | 691 | 848 | 1005 | 1162 | 1319 | 1476 |
| iPS: 361120 | 6A5.004.009 | 64 | 221 | 378 | 535 | 692 | 849 | 1006 | 1163 | 1320 | 1477 |
| iPS: 359896 | 6A5.004.010 | 65 | 222 | 379 | 536 | 693 | 850 | 1007 | 1164 | 1321 | 1478 |

TABLE 1-continued

| Identifier | Construct | Amino acid SEQ ID NOs. VL | VH | LC | HC | CDRL1 | CDRL2 | CDRL3 | CDRH1 | CDRH2 | CDRH3 |
|---|---|---|---|---|---|---|---|---|---|---|---|
| iPS: 359890 | 6A5.004.011 | 66 | 223 | 380 | 537 | 694 | 851 | 1008 | 1165 | 1322 | 1479 |
| iPS: 359567 | 2A11.002 | 67 | 224 | 381 | 538 | 695 | 852 | 1009 | 1166 | 1323 | 1480 |
| iPS: 335965 | 2A11.003 | 68 | 225 | 382 | 539 | 696 | 853 | 1010 | 1167 | 1324 | 1481 |
| iPS: 361158 | 2A11.004 | 69 | 226 | 383 | 540 | 697 | 854 | 1011 | 1168 | 1325 | 1482 |
| iPS: 361165 | 2A11.005 | 70 | 227 | 384 | 541 | 698 | 855 | 1012 | 1169 | 1326 | 1483 |
| iPS: 361172 | 2G10_LC1.003 | 71 | 228 | 385 | 542 | 699 | 856 | 1013 | 1170 | 1327 | 1484 |
| iPS: 361178 | 2G10_LC1.004 | 72 | 229 | 386 | 543 | 700 | 857 | 1014 | 1171 | 1328 | 1485 |
| iPS: 361185 | 2G10_LC1.005 | 73 | 230 | 387 | 544 | 701 | 858 | 1015 | 1172 | 1329 | 1486 |
| iPS: 361192 | 2G10_LC1.006 | 74 | 231 | 388 | 545 | 702 | 859 | 1016 | 1173 | 1330 | 1487 |
| iPS: 359609 | 2G10_LC1.007 | 75 | 232 | 389 | 546 | 703 | 860 | 1017 | 1174 | 1331 | 1488 |
| iPS: 359615 | 2G10_LC1.008 | 76 | 233 | 390 | 547 | 704 | 861 | 1018 | 1175 | 1332 | 1489 |
| iPS: 361196 | 2G10_LC1.009 | 77 | 234 | 391 | 548 | 705 | 862 | 1019 | 1176 | 1333 | 1490 |
| iPS: 361202 | 2G10_LC1.010 | 78 | 235 | 392 | 549 | 706 | 863 | 1020 | 1177 | 1334 | 1491 |
| iPS: 359644 | 18E3.002 | 79 | 236 | 393 | 550 | 707 | 864 | 1021 | 1178 | 1335 | 1492 |
| iPS: 361206 | 18E3.003 | 80 | 237 | 394 | 551 | 708 | 865 | 1022 | 1179 | 1336 | 1493 |
| iPS: 359628 | 18E3.004 | 81 | 238 | 395 | 552 | 709 | 866 | 1023 | 1180 | 1337 | 1494 |
| iPS: 359637 | 18E3.005 | 82 | 239 | 396 | 553 | 710 | 867 | 1024 | 1181 | 1338 | 1495 |
| iPS: 361210 | 18E3.006 | 83 | 240 | 397 | 554 | 711 | 868 | 1025 | 1182 | 1339 | 1496 |
| iPS: 361214 | 18E3.007 | 84 | 241 | 398 | 555 | 712 | 869 | 1026 | 1183 | 1340 | 1497 |
| iPS: 361218 | 18E3.008 | 85 | 242 | 399 | 556 | 713 | 870 | 1027 | 1184 | 1341 | 1498 |
| iPS: 361222 | 5C2.006 | 86 | 243 | 400 | 557 | 714 | 871 | 1028 | 1185 | 1342 | 1499 |
| iPS: 361229 | 5C2.007 | 87 | 244 | 401 | 558 | 715 | 872 | 1029 | 1186 | 1343 | 1500 |
| iPS: 361236 | 5C2.008 | 88 | 245 | 402 | 559 | 716 | 873 | 1030 | 1187 | 1344 | 1501 |
| iPS: 359685 | 5C2.009 | 89 | 246 | 403 | 560 | 717 | 874 | 1031 | 1188 | 1345 | 1502 |
| iPS: 361240 | 5C2.010 | 90 | 247 | 404 | 561 | 718 | 875 | 1032 | 1189 | 1346 | 1503 |
| iPS: 361247 | 5C2.011 | 91 | 248 | 405 | 562 | 719 | 876 | 1033 | 1190 | 1347 | 1504 |
| iPS: 361254 | 5C2.012 | 92 | 249 | 406 | 563 | 720 | 877 | 1034 | 1191 | 1348 | 1505 |
| iPS: 361261 | 5C2.013 | 93 | 250 | 407 | 564 | 721 | 878 | 1035 | 1192 | 1349 | 1506 |
| iPS: 361268 | 5C2.014 | 94 | 251 | 408 | 565 | 722 | 879 | 1036 | 1193 | 1350 | 1507 |
| iPS: 359669 | 5C2.015 | 95 | 252 | 409 | 566 | 723 | 880 | 1037 | 1194 | 1351 | 1508 |
| iPS: 359678 | 5C2.016 | 96 | 253 | 410 | 567 | 724 | 881 | 1038 | 1195 | 1352 | 1509 |
| iPS: 361275 | 11C1.002 | 97 | 254 | 411 | 568 | 725 | 882 | 1039 | 1196 | 1353 | 1510 |
| iPS: 361282 | 11C1.003 | 98 | 255 | 412 | 569 | 726 | 883 | 1040 | 1197 | 1354 | 1511 |
| iPS: 361289 | 11C1.004 | 99 | 256 | 413 | 570 | 727 | 884 | 1041 | 1198 | 1355 | 1512 |
| iPS: 359712 | 11C1.005 | 100 | 257 | 414 | 571 | 728 | 885 | 1042 | 1199 | 1356 | 1513 |
| iPS: 361293 | 11C1.006 | 101 | 258 | 415 | 572 | 729 | 886 | 1043 | 1200 | 1357 | 1514 |
| iPS: 361297 | 11C1.007 | 102 | 259 | 416 | 573 | 730 | 887 | 1044 | 1201 | 1358 | 1515 |
| iPS: 361301 | 11C1.008 | 103 | 260 | 417 | 574 | 731 | 888 | 1045 | 1202 | 1359 | 1516 |
| iPS: 359703 | 11C1.009 | 104 | 261 | 418 | 575 | 732 | 889 | 1046 | 1203 | 1360 | 1517 |
| iPS: 361305 | 11C1.010 | 105 | 262 | 419 | 576 | 733 | 890 | 1047 | 1204 | 1361 | 1518 |
| iPS: 361312 | 13H12.002 | 106 | 263 | 420 | 577 | 734 | 891 | 1048 | 1205 | 1362 | 1519 |
| iPS: 359744 | 13H12.003 | 107 | 264 | 421 | 578 | 735 | 892 | 1049 | 1206 | 1363 | 1520 |
| iPS: 361319 | 13H12.004 | 108 | 265 | 422 | 579 | 736 | 893 | 1050 | 1207 | 1364 | 1521 |
| iPS: 359737 | 13H12.005 | 109 | 266 | 423 | 580 | 737 | 894 | 1051 | 1208 | 1365 | 1522 |
| iPS: 361326 | 13H12.006 | 110 | 267 | 424 | 581 | 738 | 895 | 1052 | 1209 | 1366 | 1523 |
| iPS: 361330 | 12H11.002 | 111 | 268 | 425 | 582 | 739 | 896 | 1053 | 1210 | 1367 | 1524 |
| iPS: 361337 | 12H11.003 | 112 | 269 | 426 | 583 | 740 | 897 | 1054 | 1211 | 1368 | 1525 |
| iPS: 361344 | 12H11.004 | 113 | 270 | 427 | 584 | 741 | 898 | 1055 | 1212 | 1369 | 1526 |
| iPS: 361351 | 12H11.005 | 114 | 271 | 428 | 585 | 742 | 899 | 1056 | 1213 | 1370 | 1527 |
| iPS: 361358 | 12H11.006 | 115 | 272 | 429 | 586 | 743 | 900 | 1057 | 1214 | 1371 | 1528 |
| iPS: 361365 | 12H11.007 | 116 | 273 | 430 | 587 | 744 | 901 | 1058 | 1215 | 1372 | 1529 |
| iPS: 361372 | 12H11.008 | 117 | 274 | 431 | 588 | 745 | 902 | 1059 | 1216 | 1373 | 1530 |
| iPS: 361379 | 12H11.009 | 118 | 275 | 432 | 589 | 746 | 903 | 1060 | 1217 | 1374 | 1531 |
| iPS: 361383 | 12H11.010 | 119 | 276 | 433 | 590 | 747 | 904 | 1061 | 1218 | 1375 | 1532 |
| iPS: 361387 | 12H11.011 | 120 | 277 | 434 | 591 | 748 | 905 | 1062 | 1219 | 1376 | 1533 |
| iPS: 361391 | 12H11.012 | 121 | 278 | 435 | 592 | 749 | 906 | 1063 | 1220 | 1377 | 1534 |
| iPS: 361395 | 12H11.013 | 122 | 279 | 436 | 593 | 750 | 907 | 1064 | 1221 | 1378 | 1535 |
| iPS: 361402 | 12H11.014 | 123 | 280 | 437 | 594 | 751 | 908 | 1065 | 1222 | 1379 | 1536 |
| iPS: 361406 | 2C2.005.001 | 124 | 281 | 438 | 595 | 752 | 909 | 1066 | 1223 | 1380 | 1537 |
| iPS: 361412 | 2C2.005.002 | 125 | 282 | 439 | 596 | 753 | 910 | 1067 | 1224 | 1381 | 1538 |
| iPS: 361418 | 2C2.005.003 | 126 | 283 | 440 | 597 | 754 | 911 | 1068 | 1225 | 1382 | 1539 |
| iPS: 361424 | 2C2.005.004 | 127 | 284 | 441 | 598 | 755 | 912 | 1069 | 1226 | 1383 | 1540 |
| iPS: 361430 | 2C2.005.005 | 128 | 285 | 442 | 599 | 756 | 913 | 1070 | 1227 | 1384 | 1541 |
| iPS: 361436 | 2C2.005.006 | 129 | 286 | 443 | 600 | 757 | 914 | 1071 | 1228 | 1385 | 1542 |
| iPS: 361442 | 2C2.005.007 | 130 | 287 | 444 | 601 | 758 | 915 | 1072 | 1229 | 1386 | 1543 |
| iPS: 361448 | 2C2.005.008 | 131 | 288 | 445 | 602 | 759 | 916 | 1073 | 1230 | 1387 | 1544 |
| iPS: 361454 | 2C2.005.009 | 132 | 289 | 446 | 603 | 760 | 917 | 1074 | 1231 | 1388 | 1545 |
| iPS: 361460 | 2C2.005.010 | 133 | 290 | 447 | 604 | 761 | 918 | 1075 | 1232 | 1389 | 1546 |
| iPS: 361466 | 2C2.005.011 | 134 | 291 | 448 | 605 | 762 | 919 | 1076 | 1233 | 1390 | 1547 |
| iPS: 361472 | 2C2.005.012 | 135 | 292 | 449 | 606 | 763 | 920 | 1077 | 1234 | 1391 | 1548 |
| iPS: 361478 | 2C2.005.013 | 136 | 293 | 450 | 607 | 764 | 921 | 1078 | 1235 | 1392 | 1549 |
| iPS: 361485 | 2C2.005.014 | 137 | 294 | 451 | 608 | 765 | 922 | 1079 | 1236 | 1393 | 1550 |
| iPS: 361845 | 18F2.013 | 138 | 295 | 452 | 609 | 766 | 923 | 1080 | 1237 | 1394 | 1551 |
| iPS: 361851 | 6H1.009 | 139 | 296 | 453 | 610 | 767 | 924 | 1081 | 1238 | 1395 | 1552 |
| iPS: 361855 | 2C2.005.015 | 140 | 297 | 454 | 611 | 768 | 925 | 1082 | 1239 | 1396 | 1553 |
| iPS: 336067 | 5G12.006 | 141 | 298 | 455 | 612 | 769 | 926 | 1083 | 1240 | 1397 | 1554 |

TABLE 1-continued

Amino acid SEQ ID NOs.

| Identifier | Construct | VL | VH | LC | HC | CDRL1 | CDRL2 | CDRL3 | CDRH1 | CDRH2 | CDRH3 |
|---|---|---|---|---|---|---|---|---|---|---|---|
| iPS: 336169 | 17B11.002 | 142 | 299 | 456 | 613 | 770 | 927 | 1084 | 1241 | 1398 | 1555 |
| iPS: 361127 | 5G12.006.001 | 143 | 300 | 457 | 614 | 771 | 928 | 1085 | 1242 | 1399 | 1556 |
| iPS: 361136 | 5G12.006.002 | 144 | 301 | 458 | 615 | 772 | 929 | 1086 | 1243 | 1400 | 1557 |
| iPS: 361140 | 5G12.006.003 | 145 | 302 | 459 | 616 | 773 | 930 | 1087 | 1244 | 1401 | 1558 |
| iPS: 359919 | 5G12.006.004 | 146 | 303 | 460 | 617 | 774 | 931 | 1088 | 1245 | 1402 | 1559 |
| iPS: 361144 | 5G12.006.005 | 147 | 304 | 461 | 618 | 775 | 932 | 1089 | 1246 | 1403 | 1560 |
| iPS: 361151 | 5G12.006.006 | 148 | 305 | 462 | 619 | 776 | 933 | 1090 | 1247 | 1404 | 1561 |
| iPS: 361491 | 17B11.002.001 | 149 | 306 | 463 | 620 | 777 | 934 | 1091 | 1248 | 1405 | 1562 |
| iPS: 361499 | 17B11.002.002 | 150 | 307 | 464 | 621 | 778 | 935 | 1092 | 1249 | 1406 | 1563 |
| iPS: 361503 | 17B11.002.003 | 151 | 308 | 465 | 622 | 779 | 936 | 1093 | 1250 | 1407 | 1564 |
| iPS: 361507 | 17B11.002.004 | 152 | 309 | 466 | 623 | 780 | 937 | 1094 | 1251 | 1408 | 1565 |
| iPS: 361514 | 17B11.002.005 | 153 | 310 | 467 | 624 | 781 | 938 | 1095 | 1252 | 1409 | 1566 |
| iPS: 360582 | 17B11.002.006 | 154 | 311 | 468 | 625 | 782 | 939 | 1096 | 1253 | 1410 | 1567 |
| iPS: 361518 | 17B11.002.007 | 155 | 312 | 469 | 626 | 783 | 940 | 1097 | 1254 | 1411 | 1568 |
| iPS: 360570 | 17B11.002.008 | 156 | 313 | 470 | 627 | 784 | 941 | 1098 | 1255 | 1412 | 1569 |
| iPS: 362051 | 5G12.005.001 | 157 | 314 | 471 | 628 | 785 | 942 | 1099 | 1256 | 1413 | 1570 |

TABLE 2

Nucleic acid SEQ ID NOs.

| Identifier | Construct | VL | VH | LC | HC | CDRL1 | CDRL2 | CDRL3 | CDRH1 | CDRH2 | CDRH3 |
|---|---|---|---|---|---|---|---|---|---|---|---|
| iPS: 336175 | 2C2.005 | 1571 | 1728 | 1885 | 2042 | 2199 | 2356 | 2513 | 2670 | 2827 | 2984 |
| iPS: 335914 | 4B1 | 1572 | 1729 | 1886 | 2043 | 2200 | 2357 | 2514 | 2671 | 2828 | 2985 |
| iPS: 335938 | 6H1 | 1573 | 1730 | 1887 | 2044 | 2201 | 2358 | 2515 | 2672 | 2829 | 2986 |
| iPS: 335941 | 2F11 | 1574 | 1731 | 1888 | 2045 | 2202 | 2359 | 2516 | 2673 | 2830 | 2987 |
| iPS: 335970 | 5C2 | 1575 | 1732 | 1889 | 2046 | 2203 | 2360 | 2517 | 2674 | 2831 | 2988 |
| iPS: 335978 | 13H12 | 1576 | 1733 | 1890 | 2047 | 2204 | 2361 | 2518 | 2675 | 2832 | 2989 |
| iPS: 335986 | 11C1 | 1577 | 1734 | 1891 | 2048 | 2205 | 2362 | 2519 | 2676 | 2833 | 2990 |
| iPS: 335994 | 12H11 | 1578 | 1735 | 1892 | 2049 | 2206 | 2363 | 2520 | 2677 | 2834 | 2991 |
| iPS: 336024 | 18E3 | 1579 | 1736 | 1893 | 2050 | 2207 | 2364 | 2521 | 2678 | 2835 | 2992 |
| iPS: 336041 | 2G10_LC1 | 1580 | 1737 | 1894 | 2051 | 2208 | 2365 | 2522 | 2679 | 2836 | 2993 |
| iPS: 336077 | 4H9.004 | 1581 | 1738 | 1895 | 2052 | 2209 | 2366 | 2523 | 2680 | 2837 | 2994 |
| iPS: 336088 | 6A5.004 | 1582 | 1739 | 1896 | 2053 | 2210 | 2367 | 2524 | 2681 | 2838 | 2995 |
| iPS: 336099 | 17H11.004 | 1583 | 1740 | 1897 | 2054 | 2211 | 2368 | 2525 | 2682 | 2839 | 2996 |
| iPS: 359621 | 17H11.004.001 | 1584 | 1741 | 1898 | 2055 | 2212 | 2369 | 2526 | 2683 | 2840 | 2997 |
| iPS: 359781 | 4H9.004.001 | 1585 | 1742 | 1899 | 2056 | 2213 | 2370 | 2527 | 2684 | 2841 | 2998 |
| iPS: 360929 | 4H9.004.002 | 1586 | 1743 | 1900 | 2057 | 2214 | 2371 | 2528 | 2685 | 2842 | 2999 |
| iPS: 360936 | 4H9.004.003 | 1587 | 1744 | 1901 | 2058 | 2215 | 2372 | 2529 | 2686 | 2843 | 3000 |
| iPS: 360943 | 4H9.004.004 | 1588 | 1745 | 1902 | 2059 | 2216 | 2373 | 2530 | 2687 | 2844 | 3001 |
| iPS: 360949 | 4H9.004.005 | 1589 | 1746 | 1903 | 2060 | 2217 | 2374 | 2531 | 2688 | 2845 | 3002 |
| iPS: 359761 | 4H9.004.006 | 1590 | 1747 | 1904 | 2061 | 2218 | 2375 | 2532 | 2689 | 2846 | 3003 |
| iPS: 360955 | 4B1.010 | 1591 | 1748 | 1905 | 2062 | 2219 | 2376 | 2533 | 2690 | 2847 | 3004 |
| iPS: 360962 | 4B1.011 | 1592 | 1749 | 1906 | 2063 | 2220 | 2377 | 2534 | 2691 | 2848 | 3005 |
| iPS: 360968 | 4B1.012 | 1593 | 1750 | 1907 | 2064 | 2221 | 2378 | 2535 | 2692 | 2849 | 3006 |
| iPS: 360974 | 4B1.013 | 1594 | 1751 | 1908 | 2065 | 2222 | 2379 | 2536 | 2693 | 2850 | 3007 |
| iPS: 360978 | 4B1.014 | 1595 | 1752 | 1909 | 2066 | 2223 | 2380 | 2537 | 2694 | 2851 | 3008 |
| iPS: 359785 | 4B1.015 | 1596 | 1753 | 1910 | 2067 | 2224 | 2381 | 2538 | 2695 | 2852 | 3009 |
| iPS: 360982 | 4B1.016 | 1597 | 1754 | 1911 | 2068 | 2225 | 2382 | 2539 | 2696 | 2853 | 3010 |
| iPS: 335922 | 18F2 | 1598 | 1755 | 1912 | 2069 | 2226 | 2383 | 2540 | 2697 | 2854 | 3011 |
| iPS: 360986 | 18F2.002 | 1599 | 1756 | 1913 | 2070 | 2227 | 2384 | 2541 | 2698 | 2855 | 3012 |
| iPS: 360995 | 18F2.003 | 1600 | 1757 | 1914 | 2071 | 2228 | 2385 | 2542 | 2699 | 2856 | 3013 |
| iPS: 360999 | 18F2.004 | 1601 | 1758 | 1915 | 2072 | 2229 | 2386 | 2543 | 2700 | 2857 | 3014 |
| iPS: 361005 | 18F2.005 | 1602 | 1759 | 1916 | 2073 | 2230 | 2387 | 2544 | 2701 | 2858 | 3015 |
| iPS: 361009 | 18F2.006 | 1603 | 1760 | 1917 | 2074 | 2231 | 2388 | 2545 | 2702 | 2859 | 3016 |
| iPS: 361013 | 18F2.007 | 1604 | 1761 | 1918 | 2075 | 2232 | 2389 | 2546 | 2703 | 2860 | 3017 |
| iPS: 361017 | 18F2.008 | 1605 | 1762 | 1919 | 2076 | 2233 | 2390 | 2547 | 2704 | 2861 | 3018 |
| iPS: 361021 | 18F2.009 | 1606 | 1763 | 1920 | 2077 | 2234 | 2391 | 2548 | 2705 | 2862 | 3019 |
| iPS: 361028 | 18F2.010 | 1607 | 1764 | 1921 | 2078 | 2235 | 2392 | 2549 | 2706 | 2863 | 3020 |
| iPS: 360535 | 18F2.011 | 1608 | 1765 | 1922 | 2079 | 2236 | 2393 | 2550 | 2707 | 2864 | 3021 |
| iPS: 361035 | 18F2.012 | 1609 | 1766 | 1923 | 2080 | 2237 | 2394 | 2551 | 2708 | 2865 | 3022 |
| iPS: 359940 | 2F11.002 | 1610 | 1767 | 1924 | 2081 | 2238 | 2395 | 2552 | 2709 | 2866 | 3023 |
| iPS: 361039 | 2F11.003 | 1611 | 1768 | 1925 | 2082 | 2239 | 2396 | 2553 | 2710 | 2867 | 3024 |
| iPS: 361043 | 2F11.004 | 1612 | 1769 | 1926 | 2083 | 2240 | 2397 | 2554 | 2711 | 2868 | 3025 |
| iPS: 361049 | 2F11.005 | 1613 | 1770 | 1927 | 2084 | 2241 | 2398 | 2555 | 2712 | 2869 | 3026 |
| iPS: 361055 | 2F11.006 | 1614 | 1771 | 1928 | 2085 | 2242 | 2399 | 2556 | 2713 | 2870 | 3027 |
| iPS: 361059 | 2F11.007 | 1615 | 1772 | 1929 | 2086 | 2243 | 2400 | 2557 | 2714 | 2871 | 3028 |
| iPS: 361063 | 2F11.008 | 1616 | 1773 | 1930 | 2087 | 2244 | 2401 | 2558 | 2715 | 2872 | 3029 |
| iPS: 359949 | 2F11.009 | 1617 | 1774 | 1931 | 2088 | 2245 | 2402 | 2559 | 2716 | 2873 | 3030 |
| iPS: 359956 | 2F11.010 | 1618 | 1775 | 1932 | 2089 | 2246 | 2403 | 2560 | 2717 | 2874 | 3031 |
| iPS: 359865 | 6H1.002 | 1619 | 1776 | 1933 | 2090 | 2247 | 2404 | 2561 | 2718 | 2875 | 3032 |
| iPS: 359869 | 6H1.003 | 1620 | 1777 | 1934 | 2091 | 2248 | 2405 | 2562 | 2719 | 2876 | 3033 |

TABLE 2-continued

| | | Nucleic acid SEQ ID NOs. | | | | | | | | | |
|---|---|---|---|---|---|---|---|---|---|---|---|
| Identifier | Construct | VL | VH | LC | HC | CDRL1 | CDRL2 | CDRL3 | CDRH1 | CDRH2 | CDRH3 |
| iPS: 359873 | 6H1.004 | 1621 | 1778 | 1935 | 2092 | 2249 | 2406 | 2563 | 2720 | 2877 | 3034 |
| iPS: 359877 | 6H1.005 | 1622 | 1779 | 1936 | 2093 | 2250 | 2407 | 2564 | 2721 | 2878 | 3035 |
| iPS: 361067 | 6H1.006 | 1623 | 1780 | 1937 | 2094 | 2251 | 2408 | 2565 | 2722 | 2879 | 3036 |
| iPS: 361071 | 6H1.007 | 1624 | 1781 | 1938 | 2095 | 2252 | 2409 | 2566 | 2723 | 2880 | 3037 |
| iPS: 361075 | 6H1.008 | 1625 | 1782 | 1939 | 2096 | 2253 | 2410 | 2567 | 2724 | 2881 | 3038 |
| iPS: 361079 | 6A5.004.001 | 1626 | 1783 | 1940 | 2097 | 2254 | 2411 | 2568 | 2725 | 2882 | 3039 |
| iPS: 361085 | 6A5.004.002 | 1627 | 1784 | 1941 | 2098 | 2255 | 2412 | 2569 | 2726 | 2883 | 3040 |
| iPS: 361091 | 6A5.004.003 | 1628 | 1785 | 1942 | 2099 | 2256 | 2413 | 2570 | 2727 | 2884 | 3041 |
| iPS: 361095 | 6A5.004.004 | 1629 | 1786 | 1943 | 2100 | 2257 | 2414 | 2571 | 2728 | 2885 | 3042 |
| iPS: 361101 | 6A5.004.005 | 1630 | 1787 | 1944 | 2101 | 2258 | 2415 | 2572 | 2729 | 2886 | 3043 |
| iPS: 361105 | 6A5.004.006 | 1631 | 1788 | 1945 | 2102 | 2259 | 2416 | 2573 | 2730 | 2887 | 3044 |
| iPS: 361109 | 6A5.004.007 | 1632 | 1789 | 1946 | 2103 | 2260 | 2417 | 2574 | 2731 | 2888 | 3045 |
| iPS: 361113 | 6A5.004.008 | 1633 | 1790 | 1947 | 2104 | 2261 | 2418 | 2575 | 2732 | 2889 | 3046 |
| iPS: 361120 | 6A5.004.009 | 1634 | 1791 | 1948 | 2105 | 2262 | 2419 | 2576 | 2733 | 2890 | 3047 |
| iPS: 359896 | 6A5.004.010 | 1635 | 1792 | 1949 | 2106 | 2263 | 2420 | 2577 | 2734 | 2891 | 3048 |
| iPS: 359890 | 6A5.004.011 | 1636 | 1793 | 1950 | 2107 | 2264 | 2421 | 2578 | 2735 | 2892 | 3049 |
| iPS: 359567 | 2A11.002 | 1637 | 1794 | 1951 | 2108 | 2265 | 2422 | 2579 | 2736 | 2893 | 3050 |
| iPS: 335965 | 2A11.003 | 1638 | 1795 | 1952 | 2109 | 2266 | 2423 | 2580 | 2737 | 2894 | 3051 |
| iPS: 361158 | 2A11.004 | 1639 | 1796 | 1953 | 2110 | 2267 | 2424 | 2581 | 2738 | 2895 | 3052 |
| iPS: 361165 | 2A11.005 | 1640 | 1797 | 1954 | 2111 | 2268 | 2425 | 2582 | 2739 | 2896 | 3053 |
| iPS: 361172 | 2G10_LC1.003 | 1641 | 1798 | 1955 | 2112 | 2269 | 2426 | 2583 | 2740 | 2897 | 3054 |
| iPS: 361178 | 2G10_LC1.004 | 1642 | 1799 | 1956 | 2113 | 2270 | 2427 | 2584 | 2741 | 2898 | 3055 |
| iPS: 361185 | 2G10_LC1.005 | 1643 | 1800 | 1957 | 2114 | 2271 | 2428 | 2585 | 2742 | 2899 | 3056 |
| iPS: 361192 | 2G10_LC1.006 | 1644 | 1801 | 1958 | 2115 | 2272 | 2429 | 2586 | 2743 | 2900 | 3057 |
| iPS: 359609 | 2G10_LC1.007 | 1645 | 1802 | 1959 | 2116 | 2273 | 2430 | 2587 | 2744 | 2901 | 3058 |
| iPS: 359615 | 2G10_LC1.008 | 1646 | 1803 | 1960 | 2117 | 2274 | 2431 | 2588 | 2745 | 2902 | 3059 |
| iPS: 361196 | 2G10_LC1.009 | 1647 | 1804 | 1961 | 2118 | 2275 | 2432 | 2589 | 2746 | 2903 | 3060 |
| iPS: 361202 | 2G10_LC1.010 | 1648 | 1805 | 1962 | 2119 | 2276 | 2433 | 2590 | 2747 | 2904 | 3061 |
| iPS: 359644 | 18E3.002 | 1649 | 1806 | 1963 | 2120 | 2277 | 2434 | 2591 | 2748 | 2905 | 3062 |
| iPS: 361206 | 18E3.003 | 1650 | 1807 | 1964 | 2121 | 2278 | 2435 | 2592 | 2749 | 2906 | 3063 |
| iPS: 359628 | 18E3.004 | 1651 | 1808 | 1965 | 2122 | 2279 | 2436 | 2593 | 2750 | 2907 | 3064 |
| iPS: 359637 | 18E3.005 | 1652 | 1809 | 1966 | 2123 | 2280 | 2437 | 2594 | 2751 | 2908 | 3065 |
| iPS: 361210 | 18E3.006 | 1653 | 1810 | 1967 | 2124 | 2281 | 2438 | 2595 | 2752 | 2909 | 3066 |
| iPS: 361214 | 18E3.007 | 1654 | 1811 | 1968 | 2125 | 2282 | 2439 | 2596 | 2753 | 2910 | 3067 |
| iPS: 361218 | 18E3.008 | 1655 | 1812 | 1969 | 2126 | 2283 | 2440 | 2597 | 2754 | 2911 | 3068 |
| iPS: 361222 | 5C2.006 | 1656 | 1813 | 1970 | 2127 | 2284 | 2441 | 2598 | 2755 | 2912 | 3069 |
| iPS: 361229 | 5C2.007 | 1657 | 1814 | 1971 | 2128 | 2285 | 2442 | 2599 | 2756 | 2913 | 3070 |
| iPS: 361236 | 5C2.008 | 1658 | 1815 | 1972 | 2129 | 2286 | 2443 | 2600 | 2757 | 2914 | 3071 |
| iPS: 359685 | 5C2.009 | 1659 | 1816 | 1973 | 2130 | 2287 | 2444 | 2601 | 2758 | 2915 | 3072 |
| iPS: 361240 | 5C2.010 | 1660 | 1817 | 1974 | 2131 | 2288 | 2445 | 2602 | 2759 | 2916 | 3073 |
| iPS: 361247 | 5C2.011 | 1661 | 1818 | 1975 | 2132 | 2289 | 2446 | 2603 | 2760 | 2917 | 3074 |
| iPS: 361254 | 5C2.012 | 1662 | 1819 | 1976 | 2133 | 2290 | 2447 | 2604 | 2761 | 2918 | 3075 |
| iPS: 361261 | 5C2.013 | 1663 | 1820 | 1977 | 2134 | 2291 | 2448 | 2605 | 2762 | 2919 | 3076 |
| iPS: 361268 | 5C2.014 | 1664 | 1821 | 1978 | 2135 | 2292 | 2449 | 2606 | 2763 | 2920 | 3077 |
| iPS: 359669 | 5C2.015 | 1665 | 1822 | 1979 | 2136 | 2293 | 2450 | 2607 | 2764 | 2921 | 3078 |
| iPS: 359678 | 5C2.016 | 1666 | 1823 | 1980 | 2137 | 2294 | 2451 | 2608 | 2765 | 2922 | 3079 |
| iPS: 361275 | 11C1.002 | 1667 | 1824 | 1981 | 2138 | 2295 | 2452 | 2609 | 2766 | 2923 | 3080 |
| iPS: 361282 | 11C1.003 | 1668 | 1825 | 1982 | 2139 | 2296 | 2453 | 2610 | 2767 | 2924 | 3081 |
| iPS: 361289 | 11C1.004 | 1669 | 1826 | 1983 | 2140 | 2297 | 2454 | 2611 | 2768 | 2925 | 3082 |
| iPS: 359712 | 11C1.005 | 1670 | 1827 | 1984 | 2141 | 2298 | 2455 | 2612 | 2769 | 2926 | 3083 |
| iPS: 361293 | 11C1.006 | 1671 | 1828 | 1985 | 2142 | 2299 | 2456 | 2613 | 2770 | 2927 | 3084 |
| iPS: 361297 | 11C1.007 | 1672 | 1829 | 1986 | 2143 | 2300 | 2457 | 2614 | 2771 | 2928 | 3085 |
| iPS: 361301 | 11C1.008 | 1673 | 1830 | 1987 | 2144 | 2301 | 2458 | 2615 | 2772 | 2929 | 3086 |
| iPS: 359703 | 11C1.009 | 1674 | 1831 | 1988 | 2145 | 2302 | 2459 | 2616 | 2773 | 2930 | 3087 |
| iPS: 361305 | 11C1.010 | 1675 | 1832 | 1989 | 2146 | 2303 | 2460 | 2617 | 2774 | 2931 | 3088 |
| iPS: 361312 | 13H12.002 | 1676 | 1833 | 1990 | 2147 | 2304 | 2461 | 2618 | 2775 | 2932 | 3089 |
| iPS: 359744 | 13H12.003 | 1677 | 1834 | 1991 | 2148 | 2305 | 2462 | 2619 | 2776 | 2933 | 3090 |
| iPS: 361319 | 13H12.004 | 1678 | 1835 | 1992 | 2149 | 2306 | 2463 | 2620 | 2777 | 2934 | 3091 |
| iPS: 359737 | 13H12.005 | 1679 | 1836 | 1993 | 2150 | 2307 | 2464 | 2621 | 2778 | 2935 | 3092 |
| iPS: 361326 | 13H12.006 | 1680 | 1837 | 1994 | 2151 | 2308 | 2465 | 2622 | 2779 | 2936 | 3093 |
| iPS: 361330 | 12H11.002 | 1681 | 1838 | 1995 | 2152 | 2309 | 2466 | 2623 | 2780 | 2937 | 3094 |
| iPS: 361337 | 12H11.003 | 1682 | 1839 | 1996 | 2153 | 2310 | 2467 | 2624 | 2781 | 2938 | 3095 |
| iPS: 361344 | 12H11.004 | 1683 | 1840 | 1997 | 2154 | 2311 | 2468 | 2625 | 2782 | 2939 | 3096 |
| iPS: 361351 | 12H11.005 | 1684 | 1841 | 1998 | 2155 | 2312 | 2469 | 2626 | 2783 | 2940 | 3097 |
| iPS: 361358 | 12H11.006 | 1685 | 1842 | 1999 | 2156 | 2313 | 2470 | 2627 | 2784 | 2941 | 3098 |
| iPS: 361365 | 12H11.007 | 1686 | 1843 | 2000 | 2157 | 2314 | 2471 | 2628 | 2785 | 2942 | 3099 |
| iPS: 361372 | 12H11.008 | 1687 | 1844 | 2001 | 2158 | 2315 | 2472 | 2629 | 2786 | 2943 | 3100 |
| iPS: 361379 | 12H11.009 | 1688 | 1845 | 2002 | 2159 | 2316 | 2473 | 2630 | 2787 | 2944 | 3101 |
| iPS: 361383 | 12H11.010 | 1689 | 1846 | 2003 | 2160 | 2317 | 2474 | 2631 | 2788 | 2945 | 3102 |
| iPS: 361387 | 12H11.011 | 1690 | 1847 | 2004 | 2161 | 2318 | 2475 | 2632 | 2789 | 2946 | 3103 |
| iPS: 361391 | 12H11.012 | 1691 | 1848 | 2005 | 2162 | 2319 | 2476 | 2633 | 2790 | 2947 | 3104 |
| iPS: 361395 | 12H11.013 | 1692 | 1849 | 2006 | 2163 | 2320 | 2477 | 2634 | 2791 | 2948 | 3105 |
| iPS: 361402 | 12H11.014 | 1693 | 1850 | 2007 | 2164 | 2321 | 2478 | 2635 | 2792 | 2949 | 3106 |
| iPS: 361406 | 2C2.005.001 | 1694 | 1851 | 2008 | 2165 | 2322 | 2479 | 2636 | 2793 | 2950 | 3107 |
| iPS: 361412 | 2C2.005.002 | 1695 | 1852 | 2009 | 2166 | 2323 | 2480 | 2637 | 2794 | 2951 | 3108 |
| iPS: 361418 | 2C2.005.003 | 1696 | 1853 | 2010 | 2167 | 2324 | 2481 | 2638 | 2795 | 2952 | 3109 |

TABLE 2-continued

| Nucleic acid SEQ ID NOs. | | | | | | | | | | | |
|---|---|---|---|---|---|---|---|---|---|---|---|
| Identifier | Construct | VL | VH | LC | HC | CDRL1 | CDRL2 | CDRL3 | CDRH1 | CDRH2 | CDRH3 |
| iPS: 361424 | 2C2.005.004 | 1697 | 1854 | 2011 | 2168 | 2325 | 2482 | 2639 | 2796 | 2953 | 3110 |
| iPS: 361430 | 2C2.005.005 | 1698 | 1855 | 2012 | 2169 | 2326 | 2483 | 2640 | 2797 | 2954 | 3111 |
| iPS: 361436 | 2C2.005.006 | 1699 | 1856 | 2013 | 2170 | 2327 | 2484 | 2641 | 2798 | 2955 | 3112 |
| iPS: 361442 | 2C2.005.007 | 1700 | 1857 | 2014 | 2171 | 2328 | 2485 | 2642 | 2799 | 2956 | 3113 |
| iPS: 361448 | 2C2.005.008 | 1701 | 1858 | 2015 | 2172 | 2329 | 2486 | 2643 | 2800 | 2957 | 3114 |
| iPS: 361454 | 2C2.005.009 | 1702 | 1859 | 2016 | 2173 | 2330 | 2487 | 2644 | 2801 | 2958 | 3115 |
| iPS: 361460 | 2C2.005.010 | 1703 | 1860 | 2017 | 2174 | 2331 | 2488 | 2645 | 2802 | 2959 | 3116 |
| iPS: 361466 | 2C2.005.011 | 1704 | 1861 | 2018 | 2175 | 2332 | 2489 | 2646 | 2803 | 2960 | 3117 |
| iPS: 361472 | 2C2.005.012 | 1705 | 1862 | 2019 | 2176 | 2333 | 2490 | 2647 | 2804 | 2961 | 3118 |
| iPS: 361478 | 2C2.005.013 | 1706 | 1863 | 2020 | 2177 | 2334 | 2491 | 2648 | 2805 | 2962 | 3119 |
| iPS: 361485 | 2C2.005.014 | 1707 | 1864 | 2021 | 2178 | 2335 | 2492 | 2649 | 2806 | 2963 | 3120 |
| iPS: 361845 | 18F2.013 | 1708 | 1865 | 2022 | 2179 | 2336 | 2493 | 2650 | 2807 | 2964 | 3121 |
| iPS: 361851 | 6H1.009 | 1709 | 1866 | 2023 | 2180 | 2337 | 2494 | 2651 | 2808 | 2965 | 3122 |
| iPS: 361855 | 2C2.005.015 | 1710 | 1867 | 2024 | 2181 | 2338 | 2495 | 2652 | 2809 | 2966 | 3123 |
| iPS: 336067 | 5G12.006 | 1711 | 1868 | 2025 | 2182 | 2339 | 2496 | 2653 | 2810 | 2967 | 3124 |
| iPS: 336169 | 17B11.002 | 1712 | 1869 | 2026 | 2183 | 2340 | 2497 | 2654 | 2811 | 2968 | 3125 |
| iPS: 361127 | 5G12.006.001 | 1713 | 1870 | 2027 | 2184 | 2341 | 2498 | 2655 | 2812 | 2969 | 3126 |
| iPS: 361136 | 5G12.006.002 | 1714 | 1871 | 2028 | 2185 | 2342 | 2499 | 2656 | 2813 | 2970 | 3127 |
| iPS: 361140 | 5G12.006.003 | 1715 | 1872 | 2029 | 2186 | 2343 | 2500 | 2657 | 2814 | 2971 | 3128 |
| iPS: 359919 | 5G12.006.004 | 1716 | 1873 | 2030 | 2187 | 2344 | 2501 | 2658 | 2815 | 2972 | 3129 |
| iPS: 361144 | 5G12.006.005 | 1717 | 1874 | 2031 | 2188 | 2345 | 2502 | 2659 | 2816 | 2973 | 3130 |
| iPS: 361151 | 5G12.006.006 | 1718 | 1875 | 2032 | 2189 | 2346 | 2503 | 2660 | 2817 | 2974 | 3131 |
| iPS: 361491 | 17B11.002.001 | 1719 | 1876 | 2033 | 2190 | 2347 | 2504 | 2661 | 2818 | 2975 | 3132 |
| iPS: 361499 | 17B11.002.002 | 1720 | 1877 | 2034 | 2191 | 2348 | 2505 | 2662 | 2819 | 2976 | 3133 |
| iPS: 361503 | 17B11.002.003 | 1721 | 1878 | 2035 | 2192 | 2349 | 2506 | 2663 | 2820 | 2977 | 3134 |
| iPS: 361507 | 17B11.002.004 | 1722 | 1879 | 2036 | 2193 | 2350 | 2507 | 2664 | 2821 | 2978 | 3135 |
| iPS: 361514 | 17B11.002.005 | 1723 | 1880 | 2037 | 2194 | 2351 | 2508 | 2665 | 2822 | 2979 | 3136 |
| iPS: 360582 | 17B11.002.006 | 1724 | 1881 | 2038 | 2195 | 2352 | 2509 | 2666 | 2823 | 2980 | 3137 |
| iPS: 361518 | 17B11.002.007 | 1725 | 1882 | 2039 | 2196 | 2353 | 2510 | 2667 | 2824 | 2981 | 3138 |
| iPS: 360570 | 17B11.002.008 | 1726 | 1883 | 2040 | 2197 | 2354 | 2511 | 2668 | 2825 | 2982 | 3139 |
| iPS: 362051 | 5G12.005.001 | 1727 | 1884 | 2041 | 2198 | 2355 | 2512 | 2669 | 2826 | 2983 | 3140 |

TABLE 3

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| iPS:336175 | 2C2.005 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAATGGTCCGGTAT TCGGCGGAGGGACCAAGCTGACCGTCCTAGGT SEQ ID NO: 1571 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1728 |
| | | AA | QSVLTQPPSASGTPGQRVTISCSGSSSNIGSNTVNW YQHLPGTAPKLLIYTNNQRPSGVPDRFSGSKSGTS ASLAISGLQSEDEADYFCATFDDSLNGPVFGGGTK LTVLG SEQ ID NO: 1 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 158 |
| iPS:335914 | 4B1 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1572 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGGAA GTAATGAAAACTATGCAGACTCCGTGAAGGGCC GATTCACCATCTCCAGAGACAATTCCAAGAATA CGCTGTATCTGCACATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCA SEQ ID NO: 1729 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGPGTKVDIKR<br>SEQ ID NO: 2 | QVQLVESGGGVVQPGRSLRLSCAASGFTFSNFGM<br>HWVRQAPGKGLEWVAVIWYDGSNENYADSVKG<br>RFTISRDNSKNTLYLHMNSLRVADTAVYYCARDG<br>TIFGVVLGDYWGQGTLVTVSS<br>SEQ ID NO: 159 |
| iPS:335938 | 6H1 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1573 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGGAA<br>GTAATAAATACTATGCAGACTCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCA<br>SEQ ID NO: 1730 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGPGTKVDIKR<br>SEQ ID NO: 3 | QVQLVESGGGVVQPGRSLRLSCAASGFTFSYFGM<br>HWVRQAPGKGLEWVAVIWYDGSNKYYADSVKG<br>RFTISRDNSKNTLYLQMNSLRAEDTAVYYCARDG<br>TIFGVLLGDYWGQGTLVTVSS<br>SEQ ID NO: 160 |
| iPS:335941 | 2F11 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATATTGCAACATATTACTGTCA<br>ACAGTATGATATTCTCCTCACTTTCGGCGGAGG<br>GACCAAGGTGGAGATCAAGCGA<br>SEQ ID NO: 1574 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGGA<br>AGTAATAAATACTATGCAGACTCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1731 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDIATYYCQQYDILLTFGGGTKVEIK<br>R<br>SEQ ID NO: 4 | QVQLVESGGGVVQPGRSLRLSCAASGFTFSSYGM<br>HWVRQAPGKGLEWVAVIWYDGSNKYYADSVKG<br>RFTISSDNSKNTLYLQMNSLRAEDTAVYYCARDR<br>TIFGVVLDYWGQGTLVTVSS<br>SEQ ID NO: 161 |
| iPS:335970 | 5C2 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1575 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACAGT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1732 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 5 | QVPLVQSGAEVKKPGASVKVSCKASGYTFTGYYI<br>HWVRQAPGQGLEWMGWINPDSGGTDYSQRFQGR<br>FTMTRDTSISTAYMELNRLRSDDTAVYYCAREATI<br>FGMVIVPFDYWGQGTLVTVSS<br>SEQ ID NO: 162 |
| iPS:335978 | 13H12 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGACAGT<br>GGTGGCACAGACTATTCACAGAGGTTTCAGGGC<br>AGGTTCACCATGACCAGGGACACGTCCATCAGC<br>ACAGCCTACATGGAACTGAGCAGGCTGAGATCT<br>GACGACACGGCCGTGTATTACTGTGCGAGAGAG |

TABLE 3-continued

| iPS# | Ab | Type | VL | VH |
|---|---|---|---|---|
| | | | TCCGTGGACGTTCGGCCAAGGGACCAAGGTGGA AATCAAACGA SEQ ID NO: 1576 | GCCACGATTTTTGGAATGGTTATTGTACCGTTTG ACTACTGGGGCCAGGGAACCCTGGTCACCGTCT CCTCA SEQ ID NO: 1733 |
| | | AA | DIVMTQSPDSLAVSLGERATINCKSSQSVLSSSNNK NYIAWYQQKPGHPPKLLIYWASTRESGVPDRFSGS GSGTDFTLTISSLQAEDVAVFYCQQYYSTPWTFGQ GTKVEIKR SEQ ID NO: 6 | QVPLVQSGAEVKKPGASVKVSCKASGYTFTGYYI HWVRQAPGQGLEWMGWINPDSGGTDYSQRFQGR FTMTRDTSISTAYMELSRLRSDDTAVYYCAREATI FGMVIVPFDYWGQGTLVTVSS SEQ ID NO: 163 |
| iPS:335986 | 11C1 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1577 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGACACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTACGAGAGAG GCCACGATTTTTGGAATGCTTATTGTACCATTTG ACTACTGGGGCCAGGGAACCCTGGTCACCGTCT CCTCA SEQ ID NO: 1734 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKR SEQ ID NO: 7 | QVPLVQSGAEVKKPGASVKVSCKASGYTFTGYYI HWVRQAPGQGLVWMGWISPNSGDTSYAQKFQDR VTMTRDTSISTAYMELSRLRSDDTAVYFCTREATI FGMLIVPFDYWGQGTLVTVSS SEQ ID NO: 164 |
| iPS:335994 | 12H11 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1578 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGACACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTACGAGAGAG GCCACGATTTTTGGAATGCTTATTGTACCATTTG ACTACTGGGGCCAGGGAACCCTGGTCACCGTCT CCTCA SEQ ID NO: 1735 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKR SEQ ID NO: 8 | QVPLVQSGAEVKKPGASVKVSCKASGYTFTGYYI HWVRQAPGQGLEWMGWISPNNGDTNYAQKFQD RVTMTRDTSISTAYMELSRLRSDDTAVYYCTREA TIFGMLIVPFDYWGQGTLVTVSS SEQ ID NO: 165 |
| iPS:336024 | 18E3 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACAGGAGCCTGATGATTTTGCAGTGTATTACT GTCAGCAGTATGGTAGTTCACCGCTCACTTTCGG CGGAGGGACCAAGGTGGAGATCAAACGA SEQ ID NO: 1579 | CAGGTGCAGTTGCAGGAGTCGGGCCCAGGACTG GTGAAGCCTTCACAGACCCTGTCCCTCACCTGC ACTGTCTCTGGTGACTCCATCAGCAGTGGTGGTT ACTACTGGAGCTGGATCCGCCAGCACCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCA SEQ ID NO: 1736 |
| | | AA | EIVLTQSPGTLSLSPGERATLSCRASQSISYSYLAW YQQKPGQAPRLLIYGASSRATGIPDRFSGSGSGTDF TLTISRQEPDDFAVYYCQQYGSSPLTFGGGTKVEI KR SEQ ID NO: 9 | QVQLQESGPGLVKPSQTLSLTCTVSGDSISSGGYY WSWIRQHPGKGLEWIGYIYYSGSTYYNPSLKSRVT ISVDTSKNQFSLKLSSVTAADTAVYYCARDRITIFG VVMGGGMDVWGQGTTVTVSS SEQ ID NO: 166 |
| IPS: 336041 | 2G10_LC1 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG |

Exemplary Variable Light and Variable Heavy Regions: Nucleic Acid ("NA") and Amino Acid ("AA") Sequences TABLE 3-continued Exemplary Variable Light and Variable Heavy Regions: Nucleic Acid ("NA") and Amino Acid ("AA") Sequences

| iPS# | Ab | Type | VL | VH |
|---|---|---|---|---|
| | | | AGGCTCCTCATCTATGGTGCAGCCACCAGGGCC ACTGGTATCCCAGCCAGGGTCAGTGGCAGTGGG TCTGGGACAGAGTTCACTCTCACCATCAGCAGC CTGCAGTCTGAAGATTTTGCAGTTTATTACTGTC AGCAGTATAATAACTGGCCTCTCACTTTCGGCG GAGGGACCAAGGTGGAGATCAAACGA SEQ ID NO: 1580 | CTGGAGTGGGTGGCAGCTATATGGTTTGATGGA AGTGATAAATACTATGCAGACTCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCA SEQ ID NO: 1737 |
| | | AA | EIVMTQSPATLSVSPGERATLSCRASQSVSSNLAW YQQKPGQAPRLLIYGAATRATGIPARVSGSGSGTE FTLTISSLQSEDFAVYYCQQYNNWPLTFGGGTKVE KR SEQ ID NO: 10 | QVQLVESGGGVVQPGRSLRLSCAASGFTFSNYGM HWVRQAPGEGLEWVAAIWFDGSDKYYADSVKG RFTISRDNSKNTLYLQMNSLRAEDTAVYYCARDQ AIFGVVPDYWGQGTLVTVSS SEQ ID NO: 167 |
| iPS:336077 | 4H9.004 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACGCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCCT GGGACCAAAGTGGATGTCAAACGA SEQ ID NO: 1581 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1738 |
| | | AA | DIQMTQSPSSLSASVGDRVTITCRASQGIRNELGW YQQKPGKAPKRLIYGASSLQSGVPSRFSGSGSGTE FTLTISSLQPEDFVTYYCLQHNSYPFTFGPGTKVDV KR SEQ ID NO: 11 | QVQLVESGGGVVQPGRSLRLSCAASGFTFSYFGM HWVRQAPGKGLEWVAVIWYDGSNKYYADSVKG RFTISRDNSKNTLYLQMNSLRAEDTAVYYCARDG TIFGVLLGDYWGQGTLVTVSS SEQ ID NO: 168 |
| iPS:336088 | 6A5.004 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTTTCACCATCAGCAGCCTG CAGCCTGAAGATATTGCAACATATTACTGTCAA CAGTATGATGATCTATTCACTTTCGGCCCTGGGA CCAAAGTGGATATCAAACGA SEQ ID NO: 1582 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGGAA ATAATAAATACTATGCAGACTCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACCTCG GCCAGGGAACCCTGGTCACCGTCTCCTCA SEQ ID NO: 1739 |
| | | AA | DIQMTQSPSSLSASVGDRVTITCQASQDITNYLNW YQQKPGKAPKLLIYDASNLEPGVPSRFSGSGSGTD FTFTISSLQPEDIATYYCQQYDDLFTFGPGTKVDIK R SEQ ID NO: 12 | QVQLVESGGGVVQPGRSLRLSCAASGFSFSSYGM HWVRQPPGKGLEWVAAIWYDGNNKYYADSVKG RFTISRDSSKNTLYLQMNSLRAEDTAVYYCARDR TIFGVVLEYLGQGTLVTVSS SEQ ID NO: 169 |
| iPS:336099 | 17H11.004 | NA | GACATCCAGATGACCCAGTCTCCATCTTCCGTGT CTGCATCTGTAGGAGACAGAGTCACCATCACTT GTCGGGCGAGTCAGGGTCTTATCATCTGGTTAG CCTGGTATCAGCAGAAACCGGGGAAAGCCCCTA AACTCCTGATCTATGCTGCATCCAGTTTGCAAAG TGGGGTCCCATCAAGGTTCAGCGGCAGTGGCTC TGGGACAGATTTCACTCTCACCATCAGCAGCCT ACAGCCTGAAGATTTTGCAACTTACTATTGTCAA CAGACTAACAGTTTCCCTCCGACGTTCGGCCAA GGGACCAAGGTGGAAATCAAACGA SEQ ID NO: 1583 | CAGGTGCAGCTGCAGGAGTCGGGCCCAGGACTG GTGAAGCCTTCGGAGACCCTGTCCCTCACCTGC ACTGTCTCTCAGGGCTCCATCAGTAGTTACTACT GGAGCTGGATCCGGCAGCCCGCCGGGAAGGGA CTAGAGTGGATTGGCCGTATCTATACCAGTGGG AGCACCAACTACAACCCCTCCCTCAAGAGTCGA GTCACCATGTCAATAGACACGTCCAAGAACCAG TTCTCCCTGAAACTGAACTCTGTGACCGCCGCG GACACGGCCGTGTATTACTGTGCGAGAGATGTA GCAGTGGCTGGCTTTGACTACTGGGGCCAGGGA ACCCTGGTCACCGTCTCCTCA SEQ ID NO: 1740 |
| | | AA | DIQMTQSPSSVSASVGDRVTITCRASQGLIIWLAW YQQKPGKAPKLLIYAASSLQSGVPSRFSGSGSGTD FTLTISSLQPEDFATYYCQQTNSFPPTFGQGTKVEI KR SEQ ID NO: 13 | QVQLQESGPGLVKPSETLSLTCTVSQGSISSYYWS WIRQPAGKGLEWIGRIYTSGSTNYNPSLKSRVTMS IDTSKNQFSLKLNSVTAADTAVYYCARDVAVAGF DYWGQGTLVTVSS SEQ ID NO: 170 |
| iPS:359621 | 17H11. 004.001 | NA | GACATCCAGATGACCCAGTCTCCATCTTCCGTGT CTGCATCTGTAGGAGACAGAGTCACCATCACTT GTCGGGCGAGTCAGGGTCTTATCATCTGGTTAG | CAGGTGCAGCTGCAGGAGTCGGGCCCAGGACTG GTGAAGCCTTCGGAGACCCTGTCCCTCACCTGC ACTGTCTCTGGGGGCTCCATCAGTAGTTACTACT |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | | CCTGGTATCAGCAGAAACCGGGGAAAGCCCCTA AACTCCTGATCTATGCTGCATCCAGTTTGCAAAG TGGGGTCCCATCAAGGTTCAGCGGCAGTGGCTC TGGGACAGATTTCACTCTCACCATCAGCAGCCT ACAGCCTGAAGATTTTGCAACTTACTATTGTCAA CAGACTAACAGTTTCCCTCCGACGTTCGGCCAA GGGACCAAGGTGGAAATCAAACGA SEQ ID NO: 1584 | GGAGCTGGATCCGGCAGCCCGCCGGGAAGGGA CTAGAGTGGATTGGCCGTATCTATACCAGTGGG AGCACCAACTACAACCCCTCCCTCAAGAGTCGA GTCACCATGTCAATAGACACGTCCAAGAACCAG TTCTCCCTGAAACTGAACTCTGTGACCGCCGCG GACACGGCCGTGTATTACTGTGCGAGAGATGTA GCAGTGGCTGGCTTTGACTACTGGGGCCAGGGA ACCCTGGTCACCGTCTCCTCA SEQ ID NO: 1741 |
| | | AA | DIQMTQSPSSVSASVGDRVTITCRASQGLIIWLAW YQQKPGKAPKLLIYAASSLQSGVPSRFSGSGSGTD FTLTISSLQPEDFATYYCQQTNSFPPTFGQGTKVEI KR SEQ ID NO: 14 | QVQLQESGPGLVKPSETLSLTCTVSGGSISSYYWS WIRQPAGKGLEWIGRIYTSGSTNYNPSLKSRVTMS IDTSKNQFSLKLNSVTAADTAVYYCARDVAVAGF DYWGQGTLVTVSS SEQ ID NO: 171 |
| iPS:359781 | 4H9.004. 001 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGA SEQ ID NO: 1585 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1742 |
| | | AA | DIQMTQSPSSLSASVGDRVTITCRASQGIRNELGW YQQKPGKAPKLLIYGASSLQSGVPSRFSGSGSGTE FTLTIS SLQPEDFVTYYCLQHNSYPFTFGQGTKVD VKR SEQ ID NO: 15 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDG TIFGVLLGDYWGQGTLVTVSS SEQ ID NO: 172 |
| iPS:360929 | 4H9.004. 002 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGA SEQ ID NO: 1586 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1743 |
| | | AA | DIQMTQSPSSLSASVGDRVTITCRASQGIRNELGW YQQKPGKAPKLLIYGASSLQSGVPSRFSGSGSGTE FTLTISSLQPEDFVTYYCLQHNSYPFTFGQGTKVD VKR SEQ ID NO: 16 | QVQLVESGGGVVQPGRSLRLSCAASGFTFSYFGM HWVRQAPGKGLEWVAVIWYDASNKYYADSVKG RFTISRDNSKNTLYLQMNSLRAEDTAVYYCARDG TIFGVLLGDYWGQGTLVTVSS SEQ ID NO: 173 |
| iPS:360936 | 4H9.004. 003 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGA SEQ ID NO: 1587 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1744 |
| | | AA | DIQMTQSPSSLSASVGDRVTITCRASQGIRNELGW YQQKPGKAPKLLIYGASSLQSGVPSRFSGSGSGTE FTLTISSLQPEDFVTYYCLQHNSYPFTFGQGTKVD VKR SEQ ID NO: 17 | QVQLVESGGGVVQPGRSLRLSCAASGFTFSYFGM HWVRQAPGKGLEWVAVIWYDGSNKYYADAVKG RFTISRDNSKNTLYLQMNSLRAEDTAVYYCARDG TIFGVLLGDYWGQGTLVTVSS SEQ ID NO: 174 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| iPS:360943 | 4H9.004.004 | NA | GACATTCAGATGACCCAGTCTCCATCCTCCCTGTCTGCATCTGTAGGAGACAGAGTCACCATCACTTGCCGGGCAAGTCAGGGCATTAGAAATGAGTTAGGCTGGTATCAGCAGAAACCAGGGAAAGCCCCTAAACTCCTGATCTATGGTGCATCCAGTTTGCAAAGTGGGGTCCCATCAAGGTTCAGCGGCAGTGGATCTGGGACAGAGTTCACTCTCACAATCAGCAGCCTGCAGCCTGAAGATTTTGTAACTTATTACTGTCTACAGCATAATAGTTACCCATTCACTTTCGGCCCTGGGACCAAAGTGGATGTCAAACGA SEQ ID NO: 1588 | CAGGTGCAGCTGGTGGAGTCTGGGGGAGGCGTGGTCCAGCCTGGGAGGTCCCTGAGACTCTCCTGTGCAGCGTCTGGATTCACCTTCAGTTACTTTGGCATGCACTGGGTCCGCCAGGCTCCAGGCAAGGGGCTGGAGTGGGTGGCAGTTATATGGTATGATGCAAGTAATAAATACTATGCAGACGCCGTGAAGGGCCGCTTCACCATCTCCAGAGACAATTCCAAGAACACGCTGTATCTGCAAATGAACAGCCTGAGAGCCGAGGACACGGCTGTGTATTACTGTGCGCGAGATGGGACGATTTTTGGAGTGCTCTTGGGGGACTACTGGGGCCAGGGAACCCTGGTCACCGTCTCCTCA SEQ ID NO: 1745 |
| | | AA | DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGPGTKVDVKR SEQ ID NO: 18 | QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSS SEQ ID NO: 175 |
| iPS:360949 | 4H9.004.005 | NA | GACATTCAGATGACCCAGTCTCCATCCTCCCTGTCTGCATCTGTAGGAGACAGAGTCACCATCACTTGCCGGGCAAGTCAGGGCATTAGAAATGAGTTAGGCTGGTATCAGCAGAAACCAGGGAAAGCCCCTAAACGCCTGATCTATGGTGCATCCAGTTTGCAAAGTGGGGTCCCATCAAGGTTCAGCGGCAGTGGATCTGGGACAGAGTTCACTCTCACAATCAGCAGCCTGCAGCCTGAAGATTTTGTAACTTATTACTGTCTACAGCATAATAGTTACCCATTCACTTTCGGCCAAGGGACCAAAGTGGATGTCAAACGA SEQ ID NO: 1589 | CAGGTGCAGCTGGTGGAGTCTGGGGGAGGCGTGGTCCAGCCTGGGAGGTCCCTGAGACTCTCCTGTGCAGCGTCTGGATTCACCTTCAGTTACTTTGGCATGCACTGGGTCCGCCAGGCTCCAGGCAAGGGGCTGGAGTGGGTGGCAGTTATATGGTATGATGCAAGTAATAAATACTATGCAGACGCCGTGAAGGGCCGCTTCACCATCTCCAGAGACAATTCCAAGAACACGCTGTATCTGCAAATGAACAGCCTGAGAGCCGAGGACACGGCTGTGTATTACTGTGCGCGAGATGGGACGATTTTTGGAGTGCTCTTGGGGGACTACTGGGGCCAGGGAACCCTGGTCACCGTCTCCTCA SEQ ID NO: 1746 |
| | | AA | DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGQGTKVDVKR SEQ ID NO: 19 | QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSS SEQ ID NO: 176 |
| iPS:359761 | 4H9.004.006 | NA | GACATTCAGATGACCCAGTCTCCATCCTCCCTGTCTGCATCTGTAGGAGACAGAGTCACCATCACTTGCCGGGCAAGTCAGGGCATTAGAAATGAGTTAGGCTGGTATCAGCAGAAACCAGGGAAAGCCCCTAAACTCCTGATCTATGGTGCATCCAGTTTGCAAAGTGGGGTCCCATCAAGGTTCAGCGGCAGTGGATCTGGGACAGAGTTCACTCTCACAATCAGCAGCCTGCAGCCTGAAGATTTTGTAACTTATTACTGTCTACAGCATAATAGTTACCCATTCACTTTCGGCCAAGGGACCAAAGTGGATGTCAAACGA SEQ ID NO: 1590 | CAGGTGCAGCTGGTGGAGTCTGGGGGAGGCGTGGTCCAGCCTGGGAGGTCCCTGAGACTCTCCTGTGCAGCGTCTGGATTCACCTTCAGTTACTTTGGCATGCACTGGGTCCGCCAGGCTCCAGGCAAGGGGCTGGAGTGGGTGGCAGTTATATGGTATGATGCAAGTAATAAATACTATGCAGACGCCGTGAAGGGCCGCTTCACCATCTCCAGAGACAATTCCAAGAACACGCTGTATCTGCAAATGAACAGCCTGAGAGCCGAGGACACGGCTGTGTATTACTGTGCGCGAGATAGGACGATTTTTGGAGTGCTCTTGGGGGACTACTGGGGCCAGGGAACCCTGGTCACCGTCTCCTCA SEQ ID NO: 1747 |
| | | AA | DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKR SEQ ID NO: 20 | QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSS SEQ ID NO: 177 |
| iPS:360955 | 4B1.010 | NA | GACATCCAGATGACCCAGTCTCCATCCTCCCTGTCTGCATCTATAGGAGACAGAGTCACCATCACTTGCCGGGCAAGTCAGGACATTAGAGATTATTTAGGCTGGTATCAGCAGAAACCAGGGAAAGCCCCTAAGCTCCTGATCTATGGTGCATCCAGTTTGCAAAGTGGGGTCCCTTCAAGGTTCAGCGGCAGTGGATCTGGGACAGAATTCACTCTCACAATCAGCAGCCTGCAGCCTGAAGATTTCGCAACTTATTACTGTCTACAGCATAATAATTACCCCTTCACTTTCGGCCAAGGGACCAAAGTGGATATCAAACGA SEQ ID NO: 1591 | CAGGTGCAGCTGGTGGAGTCTGGGGGAGGCGTGGTCCAGCCTGGGAGGTCCCTGAGACTCTCCTGTGCAGCGTCTGGATTCACTTTCAGTAACTTTGGCATGCACTGGGTCCGCCAGGCTCCAGGCAAGGGGCTGGAGTGGGTGGCAGTTATATGGTATGATGCAAGTAATGAAAACTATGCAGACGCCGTGAAGGGCCGATTCACCATCTCCAGAGACAATTCCAAGAATACGCTGTATCTGCAAATGAACAGCCTGAGAGTCGCGGACACGGCTGTGTATTATTGTGCGCGAGATGGGACGATCTTTGGAGTGGTCTTGGGGGACTACTGGGGCCAGGGAACCCTGGTCACCGTCTCCTCA SEQ ID NO: 1748 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGQGTKVDIK R SEQ ID NO: 21 | QVQLVESGGGVVQPGRSLRLSCAASGFTFSNFGM HWVRQAPGKGLEWVAVIWYDASNENYADAVKG RFTISRDNSKNTLYLQMNSLRVADTAVYYCARDG TIFGVVLGDYWGQGTLVTVSS SEQ ID NO: 178 |
| iPS:360962 | 4B1.011 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1592 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGCAA GTAATGAAAACTATGCAGACGCCGTGAAGGGCC GATTCACCATCTCCAGAGACAATTCCAAGAATA CGCTGTATCTGCAAATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCA SEQ ID NO: 1749 |
| | | AA | DIQMTQSPSSLSASIGDRVTITCRASQDIRDYLGWY QQKPGKAPKRLIYGASSLQSGVPSRFSGSGSGTEFT LTISSLQPEDFATYYCLQHNNYPFTFGQGTKVDIK R SEQ ID NO: 22 | QVQLVESGGGVVQPGRSLRLSCAASGFTFSNFGM HWVRQAPGKGLEWVAVIWYDASNENYADAVKG RFTISRDNSKNTLYLQMNSLRVADTAVYYCARDG TIFGVVLGDYWGQGTLVTVSS SEQ ID NO: 179 |
| iPS:360968 | 4B1.012 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1593 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGCAA GTAATGAAAACTATGCAGACGCCGTGAAGGGCC GATTCACCATCTCCAGAGACAATTCCAAGAATA CGCTGTATCTGCAAATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCA SEQ ID NO: 1750 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGPGTKVDIKR SEQ ID NO: 23 | QVQLVESGGGVVQPGRSLRLSCAASGFTFSNFGM HWVRQAPGKGLEWVAVIWYDASNENYADAVKG RFTISRDNSKNTLYLQMNSLRVADTAVYYCARDG TIFGVVLGDYWGQGTLVTVSS SEQ ID NO: 180 |
| iPS:360974 | 4B1.013 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1594 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGCAA GTAATGAAAACTATGCAGACTCCGTGAAGGGCC GATTCACCATCTCCAGAGACAATTCCAAGAATA CGCTGTATCTGCACATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCA SEQ ID NO: 1751 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGQGTKVDIK R SEQ ID NO: 24 | QVQLVESGGGVVQPGRSLRLSCAASGFTFSNFGM HWVRQAPGKGLEWVAVIWYDASNENYADSVKG RFTISRDNSKNTLYLHMNSLRVADTAVYYCARDG TIFGVVLGDYWGQGTLVTVSS SEQ ID NO: 181 |
| iPS:360978 | 4B1.014 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGGAA GTAATGAAAACTATGCAGACGCCGTGAAGGGCC GATTCACCATCTCCAGAGACAATTCCAAGAATA |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | TGCAGCCTGAAGATTTCGCAACTTATTACTGTCT<br>ACAGCATAATAATTACCCCTTCACTTTCGGCCAA<br>GGGACCAAAGTGGATATCAAACGA<br>SEQ ID NO: 1595 | CGCTGTATCTGCACATGAACAGCCTGAGAGTCG<br>CGGACACGGCTGTGTATTATTGTGCGCGAGATG<br>GGACGATCTTTGGAGTGGTCTTGGGGGACTACT<br>GGGGCCAGGGAACCCTGGTCACCGTCTCCTCA<br>SEQ ID NO: 1752 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>R<br>SEQ ID NO: 25 | QVQLVESGGGVVQPGRSLRLSCAASGFTFSNFGM<br>HWVRQAPGKGLEWVAVIWYDGSNENYADAVKG<br>RFTISRDNSKNTLYLHMNSLRVADTAVYYCARDG<br>TIFGVVLGDYWGQGTLVTVSS<br>SEQ ID NO: 182 |
| iPS:359785 | 4B1.015 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGA<br>SEQ ID NO: 1596 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAATA<br>CGCTGTATCTGCAAATGAACAGCCTGAGAGTCG<br>AGGACACGGCTGTGTATTATTGTGCGCGAGATA<br>GGACGATCTTTGGAGTGGTCTTGGGGGACTACT<br>GGGGCCAGGGAACCCTGGTCACCGTCTCCTCA<br>SEQ ID NO: 1753 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>R<br>SEQ ID NO: 26 | QVQLVESGGGVVQPGRSLRLSCAASGFTFSNFGM<br>HWVRQAPGKGLEWVAVIWYDASNENYADAVKG<br>RFTISRDNSKNTLYLQMNSLRVEDTAVYYCARDR<br>TIFGVVLGDYWGQGTLVTVSS<br>SEQ ID NO: 183 |
| iPS:360982 | 4B1.016 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGA<br>SEQ ID NO: 1597 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAATA<br>CGCTGTATCTGCAAATGAACAGCCTGAGAGTCG<br>AGGACACGGCTGTGTATTATTGTGCGCGAGATG<br>GGACGATCTTTGGAGTGGTCTTGGGGGACTACT<br>GGGGCCAGGGAACCCTGGTCACCGTCTCCTCA<br>SEQ ID NO: 1754 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>R<br>SEQ ID NO: 27 | QVQLVESGGGVVQPGRSLRLSCAASGFTFSNFGM<br>HWVRQAPGKGLEWVAVIWYDASNENYADAVKG<br>RFTISRDNSKNTLYLQMNSLRVEDTAVYYCARDG<br>TIFGVVLGDYWGQGTLVTVSS<br>SEQ ID NO: 184 |
| iPS:335922 | 18F2 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1598 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGGAA<br>GTAATGAAAACTATGCAGACTCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1755 |
| | | AA | DIQMTQSPSSLSASIGDRVTITCRASQDLRNYLGW<br>YHQKPGKAPKRLIYGASSLQSGVPSRFSGSGSGTE<br>FTLTISSLQPEDFATYYCLQHNNYPFTFGPGTKVDI<br>KR<br>SEQ ID NO: 28 | QVQLVESGGGVVQPGRSLRLSCAASGFTFSNFGM<br>HWVRQAPGKGLEWVAVIWYDGSNENYADSVKG<br>RFTISRDNSKNTLYLHMNSLRAADTAVYYCARDG<br>TIFGVVLGDYWGQGTLVTVSS<br>SEQ ID NO: 185 |
| iPS:360986 | 18F2.002 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1599 | GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGACTACT<br>GGGGCCAGGGAACCCTGGTCACCGTCTCCTCA<br>SEQ ID NO: 1756 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KR<br>SEQ ID NO: 29 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSS<br>SEQ ID NO: 186 |
| iPS:360995 | 18F2.003 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1600 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGACTACT<br>GGGGCCAGGGAACCCTGGTCACCGTCTCCTCA<br>SEQ ID NO: 1757 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KR<br>SEQ ID NO: 30 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSS<br>SEQ ID NO: 187 |
| iPS:360999 | 18F2.004 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1601 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGACTACT<br>GGGGCCAGGGAACCCTGGTCACCGTCTCCTCA<br>SEQ ID NO: 1758 |
| | | AA | DIQMTQSPSSLSASIGDRVTITCRASQDLRNYLGW<br>YHQKPGKAPKLLIYGASSLQSGVPSRFSGSGSGTE<br>FTLTISSLQPEDFATYYCLQHNNYPFTFGPGTKVDI<br>KR<br>SEQ ID NO: 31 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSS<br>SEQ ID NO: 188 |
| iPS:361005 | 18F2.005 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1602 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGACTACT<br>GGGGCCAGGGAACCCTGGTCACCGTCTCCTCA<br>SEQ ID NO: 1759 |
| | | AA | DIQMTQSPSSLSASIGDRVTITCRASQDLRNYLGW<br>YQQKPGKAPKRLIYGASSLQSGVPSRFSGSGSGTE<br>FTLTISSLQPEDFATYYCLQHNNYPFTFGPGTKVDI<br>KR<br>SEQ ID NO: 32 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSS<br>SEQ ID NO: 189 |
| iPS:361009 | 18F2.006 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCGCCTGATCTATGGTGCATCCAGTTTGCAAA | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1603 | GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1760 |
| | | AA | DIQMTQSPSSLSASIGDRVTITCRASQDLRNYLGW<br>YQQKPGKAPKRLIYGASSLQSGVPSRFSGSGSGTE<br>FTLTISSLQPEDFATYYCLQHNNYPFTFGPGTKVDI<br>KR<br>SEQ ID NO: 33 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSS<br>SEQ ID NO: 190 |
| iPS:361013 | 18F2.007 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1604 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1761 |
| | | AA | DIQMTQSPSSLSASIGDRVTITCRASQDLRNYLGW<br>YHQKPGKAPKLLIYGASSLQSGVPSRFSGSGSGTE<br>FTLTISSLQPEDFATYYCLQHNNYPFTFGPGTKVDI<br>KR<br>SEQ ID NO: 34 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSS<br>SEQ ID NO: 191 |
| iPS:361017 | 18F2.003 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1605 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1762 |
| | | AA | DIQMTQSPSSLSASIGDRVTITCRASQDLRNYLGW<br>YHQKPGKAPKRLIYGASSLQSGVPSRFSGSGSGTE<br>FTLTISSLQPEDFATYYCLQHNNYPFTFGPGTKVDI<br>KR<br>SEQ ID NO: 35 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSS<br>SEQ ID NO: 192 |
| iPS:361021 | 18F2.009 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1606 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGGAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1763 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KR<br>SEQ ID NO: 36 | QVQLVESGGGVVQPGRSLRLSCAASGFTFSNFGM<br>HWVRQAPGKGLEWVAVIWYDGSNENYADAVKG<br>RFTISRDNSKNTLYLQMNSLRAADTAVYYCARDG<br>TIFGVVLGDYWGQGTLVTVSS<br>SEQ ID NO: 193 |
| iPS:361028 | 18F2.010 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1607 | TGGAGTGGGTGGCAGTTATATGGTATGATGCAA<br>GTAATGAAAACTATGCAGACTCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1764 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KR<br>SEQ ID NO: 37 | QVQLVESGGGVVQPGRSLRLSCAASGFTFSNFGM<br>HWVRQAPGKGLEWVAVIWYDASNENYADSVKG<br>RFTISRDNSKNTLYLQMNSLRAADTAVYYCARDG<br>TIFGVVLGDYWGQGTLVTVSS<br>SEQ ID NO: 194 |
| iPS:360535 | 18F2.011 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGA<br>SEQ ID NO: 1608 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>AGGACACGGCTGTGTATTACTGTGCGAGAGATA<br>GGACGATCTTTGGAGTGGTCTTGGGGGACTACT<br>GGGGCCAGGGAACCCTGGTCACCGTCTCCTCA<br>SEQ ID NO: 1765 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGQGTKVDI<br>KR<br>SEQ ID NO: 38 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAEDTAVYYCARDR<br>TIFGVVLGDYWGQGTLVTVSS<br>SEQ ID NO: 195 |
| iPS:361035 | 18F2.012 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGA<br>SEQ ID NO: 1609 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>AGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCA<br>SEQ ID NO: 1766 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYSLQHNNYPFTFGPGTKVDI<br>KR<br>SEQ ID NO: 39 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAEDTAVYYCARDG<br>TIFGVVLGDYWGQGTLVTVSS<br>SEQ ID NO: 196 |
| iPS:359940 | 2F11.002 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1610 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1767 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>R<br>SEQ ID NO: 40 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSS<br>SEQ ID NO: 197 |
| iPS:361039 | 2F11.003 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1611 | ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1768 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>R<br>SEQ ID NO: 41 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSS<br>SEQ ID NO: 198 |
| iPS:361043 | 2F11.004 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATATTGCAACATATTACTGTC<br>AACAGTATGATATTCTCCTCACTTTCGGCGGAG<br>GGACCAAGGTGGAGATCAAGCGA<br>SEQ ID NO: 1612 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1769 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDIATYYCQQYDILLTFGGGTKVEIK<br>R<br>SEQ ID NO: 42 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSS<br>SEQ ID NO: 199 |
| iPS:361049 | 2F11.005 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1613 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1770 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDFATYYCQQYDILLTFGGGTKVEIK<br>R<br>SEQ ID NO: 43 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSS<br>SEQ ID NO: 200 |
| iPS:361055 | 2F11.006 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATATTGCAACATATTACTGTC<br>AACAGTATGATATTCTCCTCACTTTCGGCGGAG<br>GGACCAAGGTGGAGATCAAGCGA<br>SEQ ID NO: 1614 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1771 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDIATYYCQQYDILLTFGGGTKVEIK<br>R<br>SEQ ID NO: 44 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSS<br>SEQ ID NO: 201 |
| iPS:361059 | 2F11.007 | NA | GACATCCAGATGACCCAGTCTCCATCCTCCCTGT<br>CTGCATCTGTAGGAGACAGAGTCACCATCACTT | CAGGTGCAACTGGTGGAGTCTGGGGGAGGCGTG<br>GTCCAGCCTGGGAGGTCCCTGAGACTCTCCTGT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1615 | GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1772 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDFATYYCQQYDILLTFGGGTKVEIK<br>R<br>SEQ ID NO: 45 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSS<br>SEQ ID NO: 202 |
| iPS:361063 | 2F11.008 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATATTGCAACATATTACTGTCA<br>ACAGTATGATATTCTCCTCACTTTCGGCGGAGG<br>GACCAAGGTGGAGATCAAGCGA<br>SEQ ID NO: 1616 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1773 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDIATYYCQQYDILLTFGGGTKVEIK<br>R<br>SEQ ID NO: 46 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSS<br>SEQ ID NO: 203 |
| iPS:359949 | 2F11.009 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1617 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACTCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1774 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>R<br>SEQ ID NO: 47 | QVQLVESGGGVVQPGRSLRLSCAASGFTFSSYGM<br>HWVRQAPGKGLEWVAVIWYDASNKYYADSVKG<br>RFTISRDNSKNTLYLQMNSLRAEDTAVYYCARDR<br>TIFGVVLDYWGQGTLVTVSS<br>SEQ ID NO: 204 |
| iPS:359956 | 2F11.010 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGA<br>SEQ ID NO: 1618 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGGA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCA<br>SEQ ID NO: 1775 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>R<br>SEQ ID NO: 48 | QVQLVESGGGVVQPGRSLRLSCAASGFTFSSYGM<br>HWVRQAPGKGLEWVAVIWYDGSNKYYADAVKG<br>RFTISRDNSKNTLYLQMNSLRAEDTAVYYCARDR<br>TIFGVVLDYWGQGTLVTVSS<br>SEQ ID NO: 205 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| iPS:359865 | 6H1.002 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1619 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1776 |
| | | AA | DIQMTQSPSSLSASIGDRVTITCRASQDIRDYLGWY QQKPGKAPKRLIYGASSLQSGVPSRFSGSGSGTEFT LTISSLQPEDFATYYSLQHNNYPFTFGPGTKVDIKR SEQ ID NO: 49 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDG TIFGVLLGDYWGQGTLVTVSS SEQ ID NO: 206 |
| iPS:359869 | 6H1.003 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1620 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATA GGACGATTTTTGGAGTGCTCTTGGGGGACTACT GGGGCCAGGGAACCCTGGTCACCGTCTCCTCA SEQ ID NO: 1777 |
| | | AA | DIQMTQSPSSLSASIGDRVTITCRASQDIRDYLGWY QQKPGKAPKRLIYGASSLQSGVPSRFSGSGSGTEFT LTISSLQPEDFATYYSLQHNNYPFTFGPGTKVDIKR SEQ ID NO: 50 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDR TIFGVLLGDYWGQGTLVTVSS SEQ ID NO: 207 |
| iPS:359873 | 6H1.004 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1621 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1778 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYSLQHNNYPFTFGQGTKVDIK R SEQ ID NO: 51 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDG TIFGVLLGDYWGQGTLVTVSS SEQ ID NO: 208 |
| iPS:359877 | 6H1.005 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1622 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATA GGACGATTTTTGGAGTGCTCTTGGGGGACTACT GGGGCCAGGGAACCCTGGTCACCGTCTCCTCA SEQ ID NO: 1779 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | AA | DIQMTQSPSSLSASIGDRVTITCRASQDIRDYLGWY QQKPGKAPKLLIYGASSLQSGVPSRFSGSGSGTEFT LTISSLQPEDFATYYSLQHNNYPFTFGQGTKVDIK R SEQ ID NO: 52 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDR TIFGVLLGDYWGQGTLVTVSS SEQ ID NO: 209 |
| iPS:361067 | 6H1.006 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1623 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1780 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGPGTKVDIKR SEQ ID NO: 53 | QVQLVESGGGVVQPGRSLRLSCAASGFTFSYFGM HWVRQAPGKGLEWVAVIWYDGSNKYYADSVKG RFTISRDNSKNTLYLQMNSLRAEDTAVYYCARDG TIFGVLLGDYWGQGTLVTVSS SEQ ID NO: 210 |
| iPS:361071 | 6H1.007 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1624 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1781 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGPGTKVDIKR SEQ ID NO: 54 | QVQLVESGGGVVQPGRSLRLSCAASGFTFSYFGM HWVRQAPGKGLEWVAVIWYDASNKYYADSVKG RFTISRDNSKNTLYLQMNSLRAEDTAVYYCARDG TIFGVLLGDYWGQGTLVTVSS SEQ ID NO: 211 |
| iPS:361075 | 6H1.008 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGA SEQ ID NO: 1625 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCA SEQ ID NO: 1782 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGPGTKVDIKR SEQ ID NO: 55 | QVQLVESGGGVVQPGRSLRLSCAASGFTFSYFGM HWVRQAPGKGLEWVAVIWYDGSNKYYADAVKG RFTISRDNSKNTLYLQMNSLRAEDTAVYYCARDG TIFGVLLGDYWGQGTLVTVSS SEQ ID NO: 212 |
| iPS:361079 | 6A5.004. 001 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATTTTGCAACATATTACTGTCA | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | ACAGTATGATGATCTATTCACTTTCGGCCCTGGG<br>ACCAAAGTGGATATCAAACGA<br>SEQ ID NO: 1626 | AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCA<br>SEQ ID NO: 1783 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGPGTKVDIK<br>R<br>SEQ ID NO: 56 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYWGQGTLVTVSS<br>SEQ ID NO: 213 |
| iPS:361085 | 6A5.004.<br>002 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATATTGCAACATATTACTGTCA<br>ACAGTATGATGATCTATTCACTTTCGGCCCTGGG<br>ACCAAAGTGGATATCAAACGA<br>SEQ ID NO: 1627 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCA<br>SEQ ID NO: 1784 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDIATYYCQQYDDLFTFGPGTKVDIK<br>R<br>SEQ ID NO: 57 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYWGQGTLVTVSS<br>SEQ ID NO: 214 |
| iPS:361091 | 6A5.004.<br>003 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCCTGGG<br>ACCAAAGTGGATATCAAACGA<br>SEQ ID NO: 1628 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCA<br>SEQ ID NO: 1785 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGPGTKVDIK<br>R<br>SEQ ID NO: 58 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSS<br>SEQ ID NO: 215 |
| iPS:361095 | 6A5.004.<br>004 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATTTTGCAACATATTACTGTCAA<br>CAGTATGATGATCTATTCACTTTCGGCCCTGGGA<br>CCAAAGTGGATATCAAACGA<br>SEQ ID NO: 1629 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCA<br>SEQ ID NO: 1786 |
| | | AA | DIQMTQSPSSLSASVGDRVTITCQASQDITNYLNW<br>YQQKPGKAPKLLIYDASNLEPGVPSRFSGSGSGTD<br>FTFTISSLQPEDFATYYCQQYDDLFTFGPGTKVDIK<br>R<br>SEQ ID NO: 59 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYWGQGTLVTVSS<br>SEQ ID NO: 216 |
| iPS:361101 | 6A5.004.<br>005 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | GCAGCCTGAAGATATTGCAACATATTACTGTCA<br>ACAGTATGATGATCTATTCACTTTCGGCCCTGGG<br>ACCAAAGTGGATATCAAACGA<br>SEQ ID NO: 1630 | CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCA<br>SEQ ID NO: 1787 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDIATYYCQQYDDLFTFGPGTKVDIK<br>R<br>SEQ ID NO: 60 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSS<br>SEQ ID NO: 217 |
| iPS:361105 | 6A5.004.<br>006 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATTTTGCAACATATTACTGTCAA<br>CAGTATGATGATCTATTCACTTTCGGCCCTGGGA<br>CCAAAGTGGATATCAAACGA<br>SEQ ID NO: 1631 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCA<br>SEQ ID NO: 1788 |
| | | AA | DIQMTQSPSSLSASVGDRVTITCQASQDITNYLNW<br>YQQKPGKAPKLLIYDASNLEPGVPSRFSGSGSGTD<br>FTFTISSLQPEDFATYYCQQYDDLFTFGPGTKVDIK<br>R<br>SEQ ID NO: 61 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSS<br>SEQ ID NO: 218 |
| iPS:361109 | 6A5.004.<br>007 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATATTGCAACATATTACTGTCAA<br>CAGTATGATGATCTATTCACTTTCGGCCCTGGGA<br>CCAAAGTGGATATCAAACGA<br>SEQ ID NO: 1632 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCA<br>SEQ ID NO: 1789 |
| | | AA | DIQMTQSPSSLSASVGDRVTITCQASQDITNYLNW<br>YQQKPGKAPKLLIYDASNLEPGVPSRFSGSGSGTD<br>FTFTISSLQPEDIATYYCQQYDDLFTFGPGTKVDIK<br>R<br>SEQ ID NO: 62 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYWGQGTLVTVSS<br>SEQ ID NO: 219 |
| iPS:361113 | 6A5.004.<br>008 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCCTGGG<br>ACCAAAGTGGATATCAAACGA<br>SEQ ID NO: 1633 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGGAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCA<br>SEQ ID NO: 1790 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGPGTKVDIK<br>R<br>SEQ ID NO: 63 | QVQLVESGGGVVQPGRSLRLSCAASGFSFSSYGM<br>HWVRQPPGKGLEWVAAIWYDGNNKYYADAVKG<br>RFTISRDSSKNTLYLQMNSLRAEDTAVYYCARDR<br>TIFGVVLEYWGQGTLVTVSS<br>SEQ ID NO: 220 |
| iPS:361120 | 6A5.004.<br>009 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACTCCGTGAAGGGCC |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | | TGGGACAGATTTTACTCTCACCATCAGCAGCCT GCAGCCTGAAGATTTTGCAACATATTACTGTCA ACAGTATGATGATCTATTCACTTTCGGCCCTGGG ACCAAAGTGGATATCAAACGA SEQ ID NO: 1634 | GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACTGGG GCCAGGGAACCCTGGTCACCGTCTCCTCA SEQ ID NO: 1791 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGPGTKVDIK R SEQ ID NO: 64 | QVQLVESGGGVVQPGRSLRLSCAASGFSFSSYGM HWVRQPPGKGLEWVAAIWYDANNKYYADSVKG RFTISRDSSKNTLYLQMNSLRAEDTAVYYCARDR TIFGVVLEYWGQGTLVTVSS SEQ ID NO: 221 |
| iPS:359896 | 6A5.004.010 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATTTTGCAACATATTACTGTCA ACAGTATGATGATCTATTCACTTTCGGCCAAGG GACCAAAGTGGATATCAAACGA SEQ ID NO: 1635 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACTGGG GCCAGGGAACCCTGGTCACCGTCTCCTCA SEQ ID NO: 1792 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGQGTKVDI KR SEQ ID NO: 65 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYWGQGTLVTVSS SEQ ID NO: 222 |
| iPS:359890 | 6A5.004.011 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATTTTGCAACATATTACTGTCA ACAGTATGATGATCTATTCACTTTCGGCCAAGG GACCAAAGTGGATATCAAACGA SEQ ID NO: 1636 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACCTCG GCCAGGGAACCCTGGTCACCGTCTCCTCA SEQ ID NO: 1793 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGQGTKVDI KR SEQ ID NO: 66 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYLGQGTLVTVSS SEQ ID NO: 223 |
| iPS:359567 | 2A11.002 | NA | GAAATTGTGTTGACGCAGTCTCCAGGCACCCTG TCTTTGTCTCCAGGGGAAAGAGCCACCCTCTCCT GCAGGGCCAGTCAGATTTTTACCAGCACCTACT TAGCCTGGTACCAGCAGAAACCTGGCCAGGCTC CCAGGCTCCTCATCTATGGTGCATCCAGCAGGG CCACTGGCATCCCAGACAGGTTCAGTGGCAGTG GGTCTGGGACAGACTTCACTCTCACCATCAGCA GATTGGAGCCTGAAGATTTTGCAGTGTATTACT GTCAGCAGTATGGTAGCTCACCTCGCTTCGGCC AAGGGACACGACTGGAGATTAAACGA SEQ ID NO: 1637 | CAGGTGCAGCTGGTGGAGTCTGGGGGAGGCGTG GTCCAGCCTGGGAGGTCCCTGAGACTCTCCTGT GCAGCGTCTGGATTCAGTTTCAGTAGCTATGGC ATGCACTGGGTCCGCCAGGCTCCAGGCAAGGGA CTGGAGTGGGTGGCAGTTATATGGTATGATGCA AGTAATAAATACTATGAAGACGCCGTGAAGGGC CGATTCACCATCTCCAGAGACAATTCCAAGAAC ACGCTGTTTCTGCAAGTGAACAGCCTGAGAGCC GAGGACACGGCTGTGTATTACTGTGCGAGAGGG ATTACGATTTTTGGTCATGGGTTTGAATATTGGG GCCAGGGAACCCTGGTCACCGTCTCCTCA SEQ ID NO: 1794 |
| | | AA | EIVLTQSPGTLSLSPGERATLSCRASQIFTSTYLAW YQQKPGQAPRLLIYGASSRATGIPDRFSGSGSGTDF TLTISRLEPEDFAVYYCQQYGSSPRFGQGTRLEIKR SEQ ID NO: 67 | QVQLVESGGGVVQPGRSLRLSCAASGFSFSSYGM HWVRQAPGKGLEWVAVIWYDASNKYYEDAVKG RFTISRDNSKNTLFLQVNSLRAEDTAVYYCARGITI FGHGFEYWGQGTLVTVSS SEQ ID NO: 224 |
| iPS:335965 | 21AA.003 | NA | GAAATTGTGTTGACGCAGTCTCCAGGCACCCTG TCTTTGTCTCCAGGGGAAAGAGCCACCCTCTCCT GCAGGGCCAGTCAGATTTTTACCAGCACCTACT TAGCCTGGTACCAGCAGAAACCTGGCCAGGCTC CCAGGCTCCTCATCTATGGTGCATCCAGCAGGG | CAGGTGCAGCTGGTGGAGTCTGGGGGAGGCGTG GTCCAGCCTGGGAGGTCCCTGAGACTCTCCTGT GCAGCGTCTGGATTCAGTTTCAGTAGCTATGGC ATGCACTGGGTCCGCCAGGCTCCAGGCAAGGGA CTGGAGTGGGTGGCAGTTATATGGTATGATGGA |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | CCACTGGCATCCCAGACAGGTTCAGTGGCAGTG<br>GGTCTGGGACAGACTTCACTCTCACCATCAGCA<br>GATTGGAGCCTGAAGATTTTGCAGTGTATTACT<br>GTCAGCAGTATGGTAGCTCACCTCGCTTCGGCC<br>AAGGGACACGACTGGAGATTAAACGA<br>SEQ ID NO: 1638 | AGTAATAAATACTATGAAGACTCCGTGAAGGGC<br>CGATTCACCATCTCCAGAGACAATTCCAAGAAC<br>ACGCTGTTTCTGCAAGTGAACAGCCTGAGAGCC<br>GAGGACACGGCTGTGTATTACTGTGCGAGAGGG<br>ATTACGATTTTTGGTCATGGGTTTGAATATTGGG<br>GCCAGGGAACCCTGGTCACCGTCTCCTCA<br>SEQ ID NO: 1795 |
| | | AA | EIVLTQSPGTLSLSPGERATLSCRASQIFTSTYLAW<br>YQQKPGQAPRLLIYGASSRATGIPDRFSGSGSGTDF<br>TLTISRLEPEDFAVYYCQQYGSSPRFGQGTRLEIKR<br>SEQ ID NO: 68 | QVQLVESGGGVVQPGRSLRLSCAASGFSFSSYGM<br>HWVRQAPGKGLEWVAVIWYDGSNKYYEDSVKG<br>RFTISRDNSKNTLFLQVNSLRAEDTAVYYCARGITI<br>FGHGFEYWGQGTLVTVSS<br>SEQ ID NO: 225 |
| iPS:361158 | 2A11.004 | NA | GAAATTGTGTTGACGCAGTCTCCAGGCACCCTG<br>TCTTTGTCTCCAGGGGAAAGAGCCACCCTCTCCT<br>GCAGGGCCAGTCAGATTTTTACCAGCACCTACT<br>TAGCCTGGTACCAGCAGAAACCTGGCCAGGCTC<br>CCAGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GATTGGAGCCTGAAGATTTTGCAGTGTATTACT<br>GTCAGCAGTATGGTAGCTCACCTCGCTTCGGCC<br>AAGGGACACGACTGGAGATTAAACGA<br>SEQ ID NO: 1639 | CAGGTGCAGCTGGTGGAGTCTGGGGGAGGCGTG<br>GTCCAGCCTGGGAGGTCCCTGAGACTCTCCTGT<br>GCAGCGTCTGGATTCAGTTTCAGTAGCTATGGC<br>ATGCACTGGGTCCGCCAGGCTCCAGGCAAGGGA<br>CTGGAGTGGGTGGCAGTTATATGGTATGATGGA<br>AGTAATAAATACTATGAAGACGCCGTGAAGGGC<br>CGATTCACCATCTCCAGAGACAATTCCAAGAAC<br>ACGCTGTTTCTGCAAGTGAACAGCCTGAGAGCC<br>GAGGACACGGCTGTGTATTACTGTGCGAGAGGG<br>ATTACGATTTTTGGTCATGGGTTTGAATATTGGG<br>GCCAGGGAACCCTGGTCACCGTCTCCTCA<br>SEQ ID NO: 1796 |
| | | AA | EIVLTQSPGTLSLSPGERATLSCRASQIFTSTYLAW<br>YQQKPGQAPRLLIYGASSRATGIPDRFSGSGSGTDF<br>TLTISRLEPEDFAVYYCQQYGSSPRFGQGTRLEIKR<br>SEQ ID NO: 69 | QVQLVESGGGVVQPGRSLRLSCAASGFSFSSYGM<br>HWVRQAPGKGLEWVAVIWYDGSNKYYEDAVKG<br>RFTISRDNSKNTLFLQVNSLRAEDTAVYYCARGITI<br>FGHGFEYWGQGTLVTVSS<br>SEQ ID NO: 226 |
| iPS:361165 | 2A11.005 | NA | GAAATTGTGTTGACGCAGTCTCCAGGCACCCTG<br>TCTTTGTCTCCAGGGGAAAGAGCCACCCTCTCCT<br>GCAGGGCCAGTCAGATTTTTACCAGCACCTACT<br>TAGCCTGGTACCAGCAGAAACCTGGCCAGGCTC<br>CCAGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GATTGGAGCCTGAAGATTTTGCAGTGTATTACT<br>GTCAGCAGTATGGTAGCTCACCTCGCTTCGGCC<br>AAGGGACACGACTGGAGATTAAACGA<br>SEQ ID NO: 1640 | CAGGTGCAGCTGGTGGAGTCTGGGGGAGGCGTG<br>GTCCAGCCTGGGAGGTCCCTGAGACTCTCCTGT<br>GCAGCGTCTGGATTCAGTTTCAGTAGCTATGGC<br>ATGCACTGGGTCCGCCAGGCTCCAGGCAAGGGA<br>CTGGAGTGGGTGGCAGTTATATGGTATGATGCA<br>AGTAATAAATACTATGAAGACTCCGTGAAGGGC<br>CGATTCACCATCTCCAGAGACAATTCCAAGAAC<br>ACGCTGTTTCTGCAAGTGAACAGCCTGAGAGCC<br>GAGGACACGGCTGTGTATTACTGTGCGAGAGGG<br>ATTACGATTTTTGGTCATGGGTTTGAATATTGGG<br>GCCAGGGAACCCTGGTCACCGTCTCCTCA<br>SEQ ID NO: 1797 |
| | | AA | EIVLTQSPGTLSLSPGERATLSCRASQIFTSTYLAW<br>YQQKPGQAPRLLIYGASSRATGIPARFSGSGSGTDF<br>TLTISRLEPEDFAVYYCQQYGSSPRFGQGTRLEIKR<br>SEQ ID NO: 70 | QVQLVESGGGVVQPGRSLRLSCAASGFSFSSYGM<br>HWVRQAPGKGLEWVAVIWYDASNKYYEDSVKG<br>RFTISRDNSKNTLFLQVNSLRAEDTAVYYCARGITI<br>FGHGFEYWGQGTLVTVSS<br>SEQ ID NO: 227 |
| iPS:361172 | 2G10_LC1.<br>003 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGA<br>SEQ ID NO: 1641 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG<br>CTGGAGTGGGTGGCAGCTATATGGTTTGATGCA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCA<br>SEQ ID NO: 1798 |
| | | AA | EIVMTQSPATLSVSPGERATLSCRASQSVSSNLAW<br>YQQKPGQAPRLLIYGAATRATGIPARFSGSGSGTE<br>FTLTISSLQSEDFAVYYCQQYNNWPLTFGGGTKVE<br>IKR<br>SEQ ID NO: 71 | QVQLVESGGGVVQPGRSLRLSCAASGFTFSNYGM<br>HWVRQAPGEGLEWVAAIWFDASDKYYADAVKG<br>RFTISRDNSKNTLYLQMNSLRAEDTAVYYCARDQ<br>AIFGVVPDYWGQGTLVTVSS<br>SEQ ID NO: 228 |
| iPS:361178 | 2G10_LC1.<br>004 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGA<br>SEQ ID NO: 1642 | CTGGAGTGGGTGGCAGCTATATGGTTTGATGCA<br>AGTGATAAATACTATGCAGACTCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCA<br>SEQ ID NO: 1799 |
| | | AA | EIVMTQSPATLSVSPGERATLSCRASQSVSSNLAW<br>YQQKPGQAPRLLIYGAATRATGIPARFSGSGSGTE<br>FTLTISSLQSEDFAVYYCQQYNNWPLTFGGGTKVE<br>IKR<br>SEQ ID NO: 72 | QVQLVESGGGVVQPGRSLRLSCAASGFTFSNYGM<br>HWVRQAPGEGLEWVAAIWFDASDKYYADSVKG<br>RFTISRDNSKNTLYLQMNSLRAEDTAVYYCARDQ<br>AIFGVVPDYWGQGTLVTVSS<br>SEQ ID NO: 229 |
| iPS:361185 | 2G10_LC1.<br>005 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGA<br>SEQ ID NO: 1643 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG<br>CTGGAGTGGGTGGCAGCTATATGGTTTGATGGA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCA<br>SEQ ID NO: 1800 |
| | | AA | EIVMTQSPATLSVSPGERATLSCRASQSVSSNLAW<br>YQQKPGQAPRLLIYGAATRATGIPARFSGSGSGTE<br>FTLTISSLQSEDFAVYYCQQYNNWPLTFGGGTKVE<br>IKR<br>SEQ ID NO: 73 | QVQLVESGGGVVQPGRSLRLSCAASGFTFSNYGM<br>HWVRQAPGEGLEWVAAIWFDGSDKYYADAVKG<br>RFTISRDNSKNTLYLQMNSLRAEDTAVYYCARDQ<br>AIFGVVPDYWGQGTLVTVSS<br>SEQ ID NO: 230 |
| iPS:36192 | 2G10_LC1.<br>006 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGGTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGA<br>SEQ ID NO: 1644 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG<br>CTGGAGTGGGTGGCAGCTATATGGTTTGATGCA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCA<br>SEQ ID NO: 1801 |
| | | AA | EIVMTQSPATLSVSPGERATLSCRASQSVSSNLAW<br>YQQKPGQAPRLLIYGAATRATGIPARVSGSGSGTE<br>FTLTISSLQSEDFAVYYCQQYNNWPLTFGGGTKVE<br>IKR<br>SEQ ID NO: 74 | QVQLVESGGGVVQPGRSLRLSCAASGFTFSNYGM<br>HWVRQAPGEGLEWVAAIWFDASDKYYADAVKG<br>RFTISRDNSKNTLYLQMNSLRAEDTAVYYCARDQ<br>AIFGVVPDYWGQGTLVTVSS<br>SEQ ID NO: 231 |
| iPS:359609 | 2G10_LC1.<br>007 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGGAGCCTGAAGATTTTGCAGTTTATTACTGTC<br>AGCAGTATAATAACTTCCCTCTCACTTTCGGCGG<br>AGGGACCAAGGTGGAGATCAAACGA<br>SEQ ID NO: 1645 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCAAGGGG<br>CTGGAGTGGGTGGCAGCTATATGGTTTGATGCA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCA<br>SEQ ID NO: 1802 |
| | | AA | EIVMTQSPATLSVSPGERATLSCRASQSVSSNLAW<br>YQQKPGQAPRLLIYGAATRATGIPARFSGSGSGTE<br>FTLTISSLEPEDFAVYYCQQYNNFPLTFGGGTKVEI<br>KR<br>SEQ ID NO: 75 | QVQLVESGGGVVQPGRSLRLSCAASGFTFSNYGM<br>HWVRQAPGKGLEWVAAIWFDASDKYYADAVKG<br>RFTISRDNSKNTLYLQMNSLRAEDTAVYYCARDQ<br>AIFGVVPDYWGQGTLVTVSS<br>SEQ ID NO: 232 |
| iPS:359615 | 2G10_LC1.<br>008 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTATCCTCTCACTTTCGGCGG AGGGACCAAGGTGGAGATCAAACGA SEQ ID NO: 1646 | ATGCACTGGGTCCGCCAGGCTCCAGGCAAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCA SEQ ID NO: 1803 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNYPLTFGGGTKVEI KR SEQ ID NO: 76 | QVQLVESGGGVVQPGRSLRLSCAASGFTFSNYGM HWVRQAPGKGLEWVAAIWFDASDKYYADAVKG RFTISRDNSKNTLYLQMNSLRAEDTAVYYCARDQ AIFGVVPDYWGQGTLVTVSS SEQ ID NO: 233 |
| iPS:361196 | 2G10_LC1. 009 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTGGCCTCTCACTTTCGGCG GAGGGACCAAGGTGGAGATCAAACGA SEQ ID NO: 1647 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCA SEQ ID NO: 1804 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNWPLTFGGGTKVE IKR SEQ ID NO: 77 | QVQLVESGGGVVQPGRSLRLSCAASGFTFSNYGM HWVRQAPGEGLEWVAAIWFDASDKYYADAVKG RFTISRDNSKNTLYLQMNSLRAEDTAVYYCARDQ AIFGVVPDYWGQGTLVTVSS SEQ ID NO: 234 |
| iPS:361202 | 2G10_LC1. 010 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTGGCCTCTCACTTTCGGCG GAGGGACCAAGGTGGAGATCAAACGA SEQ ID NO: 1648 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCAAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCA SEQ ID NO: 1805 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNWPLTFGGGTKVE IKR SEQ ID NO: 78 | QVQLVESGGGVVQPGRSLRLSCAASGFTFSNYGM HWVRQAPGKGLEWVAAIWFDASDKYYADAVKG RFTISRDNSKNTLYLQMNSLRAEDTAVYYCARDQ AIFGVVPDYWGQGTLVTVSS SEQ ID NO: 235 |
| iPS:359644 | 18E3.002 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACTGGAGCCTGATGATTTTGCAGTGTATTACTG TCAGCAGTATGGTAGTTCACCGCTCACTTTCGGC GGAGGGACCAAGGTGGAGATCAAACGA SEQ ID NO: 1649 | CAGGTGCAGTTGCAGGAGTCGGGCCCAGGACTG GTGAAGCCTTCAGAGACCCTGTCCCTCACCTGC ACTGTCTCTGGTGACTCCATCAGCAGTGGTGGTT ACTACTGGAGCTGGATCCGCCAGCCCCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCA SEQ ID NO: 1806 |
| | | AA | EIVLTQSPGTLSLSPGERATLSCRASQSISYSYLAW YQQKPGQAPRLLIYGASSRATGIPDRFSGSGSGTDF TLTISRLEPDDFAVYYCQQYGSSPLTFGGGTKVEIK R SEQ ID NO: 79 | QVQLQESGPGLVKPSETLSLTCTVSGDSISSGGYY WSWIRQPPGKGLEWIGYIYYSGSTYYNPSLKSRVT ISVDTSKNQFSLKLSSVTAADTAVYYCARDRITIFG VVMGGGMDVWGQGTTVTVSS SEQ ID NO: 236 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| iPS:361206 | 18E3.003 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACAGGAGCCTGATGATTTTGCAGTGTATTACT<br>GTCAGCAGTATGGTAGTTCACCGCTCACTTTCGG<br>CGGAGGGACCAAGGTGGAGATCAAACGA<br>SEQ ID NO: 1650 | CAGGTGCAGTTGCAGGAGTCGGGCCCAGGACTG<br>GTGAAGCCTTCAGAGACCCTGTCCCTCACCTGC<br>ACTGTCTCTGGTGACTCCATCAGCAGTGGTGGTT<br>ACTACTGGAGCTGGATCCGCCAGCCCCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCA<br>SEQ ID NO: 1807 |
| | | AA | EIVLTQSPGTLSLSPGERATLSCRASQSISYSYLAW<br>YQQKPGQAPRLLIYGASSRATGIPDRFSGSGSGTDF<br>TLTISRQEPDDFAVYYCQQYGSSPLTFGGGTKVEI<br>KR<br>SEQ ID NO: 80 | QVQLQESGPGLVKPSETLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSS<br>SEQ ID NO: 237 |
| iPS:359628 | 18E3.004 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGA<br>SEQ ID NO: 1651 | CAGGTGCAGTTGCAGGAGTCGGGCCCAGGACTG<br>GTGAAGCCTTCACAGACCCTGTCCCTCACCTGC<br>ACTGTCTCTGGTGACTCCATCAGCAGTGGTGGTT<br>ACTACTGGAGCTGGATCCGCCAGCCCCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCA<br>SEQ ID NO: 1808 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>R<br>SEQ ID NO: 81 | QVQLQESGPGLVKPSQTLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSS<br>SEQ ID NO: 238 |
| iPS:359637 | 18E3.005 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGA<br>SEQ ID NO: 1652 | CAGGTGCAGTTGCAGGAGTCGGGCCCAGGACTG<br>GTGAAGCCTTCAGAGACCCTGTCCCTCACCTGC<br>ACTGTCTCTGGTGACTCCATCAGCAGTGGTGGTT<br>ACTACTGGAGCTGGATCCGCCAGCACCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCA<br>SEQ ID NO: 1809 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>R<br>SEQ ID NO: 82 | QVQLQESGPGLVKPSETLSLTCTVSGDSISSGGYY<br>WSWIRQHPGKGLEWIGYIYYSGSTYYNPSLKSRVT<br>ISVDTSKNQFSLKLSSVTAADTAVYYCARDRITIFG<br>VVMGGGMDVWGQGTTVTVSS<br>SEQ ID NO: 239 |
| iPS:361210 | 18E3.006 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGA<br>SEQ ID NO: 1653 | CAGGTGCAGTTGCAGGAGTCGGGCCCAGGACTG<br>GTGAAGCCTTCACAGACCCTGTCCCTCACCTGC<br>ACTGTCTCTGGTGACTCCATCAGCAGTGGTGGTT<br>ACTACTGGAGCTGGATCCGCCAGCACCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCA<br>SEQ ID NO: 1810 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | EIVLTQSPGTLSLSPGERATLSCRASQSISYSYLAW YQQKPGQAPRLLIYGASSRATGIPDRFSGSGSGTDF TLTISRLEPDDFAVYYCQQYGSSPLTFGGGTKVEIK R SEQ ID NO: 83 | QVQLQESGPGLVKPSQTLSLTCTVSGDSISSGGYY WSWIRQHPGKGLEWIGYIYYSGSTYYNPSLKSRVT ISVDTSKNQFSLKLSSVTAADTAVYYCARDRITIFG VVMGGGMDVWGQGTTVTVSS SEQ ID NO: 240 |
| iPS:361214 | 18E3.007 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACAGGAGCCTGATGATTTTGCAGTGTATTACT GTCAGCAGTATGGTAGTTCACCGCTCACTTTCGG CGGAGGGACCAAGGTGGAGATCAAACGA SEQ ID NO: 1654 | CAGGTGCAGTTGCAGGAGTCGGGCCCAGGACTG GTGAAGCCTTCAGAGACCCTGTCCCTCACCTGC ACTGTCTCTGGTGACTCCATCAGCAGTGGTGGTT ACTACTGGAGCTGGATCCGCCAGCACCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCA SEQ ID NO: 1811 |
| | | AA | EIVLTQSPGTLSLSPGERATLSCRASQSISYSYLAW YQQKPGQAPRLLIYGASSRATGIPDRFSGSGSGTDF TLTISRQEPDDFAVYYCQQYGSSPLTFGGGTKVEI KR SEQ ID NO: 84 | QVQLQESGPGLVKPSETLSLTCTVSGDSISSGGYY WSWIRQHPGKGLEWIGYIYYSGSTYYNPSLKSRVT ISVDTSKNQFSLKLSSVTAADTAVYYCARDRITIFG VVMGGGMDVWGQGTTVTVSS SEQ ID NO: 241 |
| iPS:361218 | 18E3.008 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACAGGAGCCTGATGATTTTGCAGTGTATTACT GTCAGCAGTATGGTAGTTCACCGCTCACTTTCGG CGGAGGGACCAAGGTGGAGATCAAACGA SEQ ID NO: 1655 | CAGGTGCAGTTGCAGGAGTCGGGCCCAGGACTG GTGAAGCCTTCACAGACCCTGTCCCTCACCTGC ACTGTCTCTGGTGACTCCATCAGCAGTGGTGGTT ACTACTGGAGCTGGATCCGCCAGCCCCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCA SEQ ID NO: 1812 |
| | | AA | EIVLTQSPGTLSLSPGERATLSCRASQSISYSYLAW YQQKPGQAPRLLIYGASSRATGIPDRFSGSGSGTDF TLTISRQEPDDFAVYYCQQYGSSPLTFGGGTKVEI KR SEQ ID NO: 85 | QVQLQESGPGLVKPSQTLSLTCTVSGDSISSGGYY WSWIRQPPGKGLEWIGYIYYSGSTYYNPSLKSRVT ISVDTSKNQFSLKLSSVTAADTAVYYCARDRITIFG VVMGGGMDVWGQGTTVTVSS SEQ ID NO: 242 |
| iPS:361222 | 5C2.006 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGA SEQ ID NO: 1656 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGAAAGT GGTGGCACAGACTATTCACAGAGGTTTCAGGGC AGGGTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCA SEQ ID NO: 1813 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKR SEQ ID NO: 86 | QVQLVQSGAEVKKPGASVKVSCKASGYTFTGYYI HWVRQAPGQGLEWMGWINPESGGTDYSQRFQGR VTMTRDTSISTAYMELNRLRSDDTAVYYCAREATI FGMVIVPFDYWGQGTLVTVSS SEQ ID NO: 243 |
| iPS:361229 | 5C2.007 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGAAAGT GGTGGCACAGACTATTCACAGAGGTTTCAGGGC AGGTTCACCATGACCAGGGACACGTCCATCAGC ACAGCCTACATGGAACTGAACAGGCTGAGATCT GACGACACGGCCGTGTATTACTGTGCGAGAGAG |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | TCCGTGGACGTTCGGCCAAGGGACCAAGGTGGA<br>AATCAAACGA<br>SEQ ID NO: 1657 | GCCACGATTTTTGGAATGGTTATTGTACCGTTTG<br>ACTACTGGGGCCAGGGAACCCTGGTCACCGTCT<br>CCTCA<br>SEQ ID NO: 1814 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 87 | QVPLVQSGAEVKKPGASVKVSCKASGYTFTGYYI<br>HWVRQAPGQGLEWMGWINPESGGTDYSQRFQGR<br>FTMTRDTSISTAYMELNRLRSDDTAVYYCAREATI<br>FGMVIVPFDYWGQGTLVTVSS<br>SEQ ID NO: 244 |
| iPS:361236 | 5C2.008: | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1658 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACGCT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1815 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 88 | QVQLVQSGAEVKKPGASVKVSCKASGYTFTGYYI<br>HWVRQAPGQGLEWMGWINPDAGGTDYSQRFQG<br>RVTMTRDTSISTAYMELNRLRSDDTAVYYCAREA<br>TIFGMVIVPFDYWGQGTLVTVSS<br>SEQ ID NO: 245 |
| iPS:359685 | 5C2.009 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1659 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACGCT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1816 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 89 | QVPLVQSGAEVKKPGASVKVSCKASGYTFTGYYI<br>HWVRQAPGQGLEWMGWINPDAGGTDYSQRFQG<br>RFTMTRDTSISTAYMELNRLRSDDTAVYYCAREA<br>TIFGMVIVPFDYWGQGTLVTVSS<br>SEQ ID NO: 246 |
| iPS:361240 | 5C2.010 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1660 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACAGT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1817 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 90 | QVQLVQSGAEVKKPGASVKVSCKASGYTFTGYYI<br>HWVRQAPGQGLEWMGWINPDSGGTDYSQRFQGR<br>VTMTRDTSISTAYMELNRLRSDDTAVYYCAREATI<br>FGMVIVPFDYWGQGTLVTVSS<br>SEQ ID NO: 247 |
| iPS:361247 | 5C2.011 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | | CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1661 | CTTGAGTGGATGGGGTGGATCAACCCTGACAGT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1818 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 91 | QVQLVQSGAEVKKPGASVKVSCKASGYTFTGYYI<br>HWVRQAPGQGLEWMGWINPDSGGTDYSQRFQGR<br>FTMTRDTSISTAYMELNRLRSDDTAVYYCAREATI<br>FGMVIVPFDYWGQGTLVTVSS<br>SEQ ID NO: 248 |
| iPS:361254 | 5C2.012 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1662 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACAGT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1819 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 92 | QVPLVQSGAEVKKPGASVKVSCKASGYTFTGYYI<br>HWVRQAPGQGLEWMGWINPDSGGTDYSQRFQGR<br>VTMTRDTSISTAYMELNRLRSDDTAVYYCAREATI<br>FGMVIVPFDYWGQGTLVTVSS<br>SEQ ID NO: 249 |
| iPS:361261 | 5C2.013 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1663 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACGCT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1820 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 93 | QVQLVQSGAEVKKPGASVKVSCKASGYTFTGYYI<br>HWVRQAPGQGLEWMGWINPDAGGTDYSQRFQG<br>RFTMTRDTSISTAYMELNRLRSDDTAVYYCAREA<br>TIFGMVIVPFDYWGQGTLVTVSS<br>SEQ ID NO: 250 |
| iPS:361268 | 5C2.014 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1664 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACGCT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1821 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKR<br>SEQ ID NO: 94 | QVPLVQSGAEVKKPGASVKVSCKASGYTFTGYYI<br>HWVRQAPGQGLEWMGWINPDAGGTDYSQRFQG<br>RVTMTRDTSISTAYMELNRLRSDDTAVYYCAREA<br>TIFGMVIVPFDYWGQGTLVTVSS<br>SEQ ID NO: 251 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| iPS:359669 | 5C2.015 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACAACCTCCTAAGCTGCTCATTTAC TGGGCATCTACCCGGGAATCCGGGGTCCCTGAC CGATTCAGTGGCAGCGGGTCTGGGACAGATTTC ACTCTCACCATCAGCAGCCTGCAGGCTGAAGAT GTGGCAGTTTTTTACTGTCAACAATATTATAGTA CTCCGTGGACGTTCGGCCAAGGGACCAAGGTGG AAATCAAACGA SEQ ID NO: 1665 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACGCT GGTGGCACAGACTATTCACAGAGGTTTCAGGGC AGGGTCACCATGACCAGGGACACGTCCATCAGC ACAGCCTACATGGAACTGAACAGCCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCA SEQ ID NO: 1822 |
| | | AA | DIVMTQSPDSLAVSLGERATINCKSSQSVLSSSNNK NYIAWYQQKPGQPPKLLIYWASTRESGVPDRFSGS GSGTDFTLTISSLQAEDVAVFYCQQYYSTPWTFGQ GTKVEIKR SEQ ID NO: 95 | QVQLVQSGAEVKKPGASVKVSCKASGYTFTGYYI HWVRQAPGQGLEWMGWINPDAGGTDYSQRFQG RVTMTRDTSISTAYMELNSLRSDDTAVYYCAREA TIFGMVIVPFDYWGQGTLVTVSS SEQ ID NO: 252 |
| iPS:359678 | 5C2.016 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACAACCTCCTAAGCTGCTCATTTAC TGGGCATCTACCCGGGAATCCGGGGTCCCTGAC CGATTCAGTGGCAGCGGGTCTGGGACAGATTTC ACTCTCACCATCAGCAGCCTGCAGGCTGAAGAT GTGGCAGTTTTTTACTGTCAACAATATTATAGTA CTCCGTGGACGTTCGGCCAAGGGACCAAGGTGG AAATCAAACGA SEQ ID NO: 1666 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGAAAGT GGTGGCACAGACTATTCACAGAGGTTTCAGGGC AGGGTCACCATGACCAGGGACACGTCCATCAGC ACAGCCTACATGGAACTGAACAGCCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCA SEQ ID NO: 1823 |
| | | AA | DIVMTQSPDSLAVSLGERATINCKSSQSVLSSSNNK NYIAWYQQKPGQPPKLLIYWASTRESGVPDRFSGS GSGTDFTLTISSLQAEDVAVFYCQQYYSTPWTFGQ GTKVEIKR SEQ ID NO: 96 | QVQLVQSGAEVKKPGASVKVSCKASGYTFTGYYI HWVRQAPGQGLEWMGWINPESGGTDYSQRFQGR VTMTRDTSISTAYMELNSLRSDDTAVYYCAREATI FGMVIVPFDYWGQGTLVTVSS SEQ ID NO: 253 |
| iPS:361275 | 11C1.002 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1667 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCA SEQ ID NO: 1824 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKR SEQ ID NO: 97 | QVPLVQSGAEVKKPGASVKVSCKASGYTFTGYYI HWVRQAPGQGLVWMGWISPNSGETSYAQKFQDR VTMTRDTSISTAYMELSRLRSDDTAVYFCAREATI FGMLIVPFDYWGQGTLVTVSS SEQ ID NO: 254 |
| iPS:361282 | 11C1.003 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1668 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGACACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCA SEQ ID NO: 1825 |

TABLE 3-continued

Exemplary Variable Light and Variable Heavy Regions: Nucleic Acid ("NA") and Amino Acid ("AA") Sequences

| iPS# | Ab | Type | VL | VH |
| --- | --- | --- | --- | --- |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKR<br>SEQ ID NO: 98 | QVPLVQSGAEVKKPGASVKVSCKASGYTFTGYYI<br>HWVRQAPGQGLVWMGWISPNSGDTSYAQKFQDR<br>VTMTRDTSISTAYMELSRLRSDDTAVYFCAREATI<br>FGMLIVPFDYWGQGTLVTVSS<br>SEQ ID NO: 255 |
| iPS:361289 | 11C1.004 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1669 | CAGGTGCCGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGTGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGACTGAGATCT<br>GACGACACGGCCGTGTATTTCTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1826 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 99 | QVPLVQSGAEVKKPGASVKVSCKASGYTFTGYYI<br>HWVRQAPGQGLVWMGWISPNSGETSYAQKFQDR<br>VTMTRDTSISTAYMELSRLRSDDTAVYFCAREATI<br>FGMLIVPFDYWGQGTLVTVSS<br>SEQ ID NO: 256 |
| iPS:359712 | 11C1.005 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1670 | CAGGTGCCGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGTGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGACTGAGATCT<br>GACGACACGGCCGTGTATTTCTGTACGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1827 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKR<br>SEQ ID NO: 100 | QVPLVQSGAEVKKPGASVKVSCKASGYTFTGYYI<br>HWVRQAPGQGLVWMGWISPNSGETSYAQKFQDR<br>VTMTRDTSISTAYMELSRLRSDDTAVYFCTREATI<br>FGMLIVPFDYWGQGTLVTVSS<br>SEQ ID NO: 257 |
| iPS:361293 | 11C1.006 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1671 | CAGGTGCCGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGTGTGGATGGGGTGGATCAGCCCTAACAGT<br>GGTGACACAAGCTATGCACAGAAGTTTCAGGAC<br>AGGGTCACCATGACCAGGGACACGTCCATCAGC<br>ACAGCCTATATGGAGCTGAGCAGACTGAGATCT<br>GACGACACGGCCGTGTATTTCTGTACGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1828 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKR<br>SEQ ID NO: 101 | QVPLVQSGAEVKKPGASVKVSCKASGYTFTGYYI<br>HWVRQAPGQGLVWMGWISPNSGDTSYAQKFQDR<br>VTMTRDTSISTAYMELSRLRSDDTAVYFCTREATI<br>FGMLIVPFDYWGQGTLVTVSS<br>SEQ ID NO: 258 |
| iPS:361297 | 11C1.007 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT | CAGGTGCCGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGTGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGACTGAGATCT |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | | GTGGCTGTTTATTACTGTCAGCAATATTATCGTA<br>CTCCGTGGACGTTCGGCCAAGGGACCAAGGTGG<br>AAATCAAACGA<br>SEQ ID NO: 1672 | GACGACACGGCCGTGTATTTCTGTACGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1829 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 102 | QVPLVQSGAEVKKPGASVKVSCKASGYTFTGYYI<br>HWVRQAPGQGLVWMGWISPNSGETSYAQKFQDR<br>VTMTRDTSISTAYMELSRLRSDDTAVYFCTREATI<br>FGMLIVPFDYWGQGTLVTVSS<br>SEQ ID NO: 259 |
| iPS:361301 | 11C1.008 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1673 | CAGGTGCCGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGTGTGGATGGGGTGGATCAGCCCTAACAGT<br>GGTGACACAAGCTATGCACAGAAGTTTCAGGAC<br>AGGGTCACCATGACCAGGGACACGTCCATCAGC<br>ACAGCCTATATGGAGCTGAGCAGACTGAGATCT<br>GACGACACGGCCGTGTATTTCTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1830 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 103 | QVPLVQSGAEVKKPGASVKVSCKASGYTFTGYYI<br>HWVRQAPGQGLVWMGWISPNSGDTSYAQKFQDR<br>VTMTRDTSISTAYMELSRLRSDDTAVYFCAREATI<br>FGMLIVPFDYWGQGTLVTVSS<br>SEQ ID NO: 260 |
| iPS:359703 | 11C1.009 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAAACTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1674 | CAGGTGCAGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGCCTGAGATCT<br>GACGACACGGCCGTGTATTTCTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1831 |
| | | AA | DIVMTQSPDSLAVSLGERATINCKSSQSVLSSSNNK<br>NYLAWYQQKPGQPPKLLIYWTSTRESGVPDRFSG<br>SGSGTDFTLTINSLQAEDVAVYYCQQYYRTPWTF<br>GQGTKVEIKR<br>SEQ ID NO: 104 | QVQLVQSGAEVKKPGASVKVSCKASGYTFTGYYI<br>HWVRQAPGQGLEWMGWISPNSGETSYAQKFQDR<br>VTMTRDTSISTAYMELSSLRSDDTAVYFCAREATI<br>FGMLIVPFDYWGQGTLVTVSS<br>SEQ ID NO: 261 |
| iPS:361305 | 11C1.010 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1675 | CAGGTGCAGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGACTGAGATCT<br>GACGACACGGCCGTGTATTTCTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1832 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKR<br>SEQ ID NO: 105 | QVQLVQSGAEVKKPGASVKVSCKASGYTFTGYYI<br>HWVRQAPGQGLEWMGWISPNSGETSYAQKFQDR<br>VTMTRDTSISTAYMELSRLRSDDTAVYFCAREATI<br>FGMLIVPFDYWGQGTLVTVSS<br>SEQ ID NO: 262 |
| iPS:361312 | 13H12.002 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | AACAATAAGAACTACATAGCTTGGTACCAGCAG<br>AAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1676 | ATCCACTGGGTGCGACAGGCCCCTGGACAAGGA<br>CTTGAGTGGATGGGGTGGATCAACCCTGAAAGT<br>GGTGGCACAGACTATTCACAGAGGTTTCAGGGC<br>AGGGTCACCATGACCAGGGACACGTCCATCAGC<br>ACAGCCTACATGGAACTGAGCAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1833 |
| | | AA | DIVMTQSPDSLAVSLGERATINCKSSQSVLSSSNNK<br>NYIAWYQQKPGHPPKLLIYWASTRESGVPDRFSGS<br>GSGTDFTLTISSLQAEDVAVFYCQQYYSTPWTFGQ<br>GTKVEIKR<br>SEQ ID NO: 106 | QVPLVQSGAEVKKPGASVKVSCKASGYTFTGYYI<br>HWVRQAPGQGLEWMGWINPESGGTDYSQRFQGR<br>VTMTRDTSISTAYMELSRLRSDDTAVYYCAREATI<br>FGMVIVPFDYWGQGTLVTVSS<br>SEQ ID NO: 263 |
| iPS:359744 | 13H12.003 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1677 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGAAAGT<br>GGTGGCACAGACTATTCACAGAGGTTTCAGGGC<br>AGGTTCACCATGACCAGGGACACGTCCATCAGC<br>ACAGCCTACATGGAACTGAGCAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1834 |
| | | AA | DIVMTQSPDSLAVSLGERATINCKSSQSVLSSSNNK<br>NYIAWYQQKPGHPPKLLIYWASTRESGVPDRFSGS<br>GSGTDFTLTISSLQAEDVAVFYCQQYYSTPWTFGQ<br>GTKVEIKR<br>SEQ ID NO: 107 | QVPLVQSGAEVKKPGASVKVSCKASGYTFTGYYI<br>HWVRQAPGQGLEWMGWINPESGGTDYSQRFQGR<br>FTMTRDTSISTAYMELSRLRSDDTAVYYCAREATI<br>FGMVIVPFDYWGQGTLVTVSS<br>SEQ ID NO: 264 |
| iPS:361319 | 13H12.004 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGA<br>SEQ ID NO: 1678 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGACAGT<br>GGTGGCACAGACTATTCACAGAGGTTTCAGGGC<br>AGGGTCACCATGACCAGGGACACGTCCATCAGC<br>ACAGCCTACATGGAACTGAGCAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1835 |
| | | AA | DIVMTQSPDSLAVSLGERATINCKSSQSVLSSSNNK<br>NYIAWYQQKPGHPPKLLIYWASTRESGVPDRFSGS<br>GSGTDFTLTISSLQAEDVAVFYCQQYYSTPWTFGQ<br>GTKVEIKR<br>SEQ ID NO: 108 | QVPLVQSGAEVKKPGASVKVSCKASGYTFTGYYI<br>HWVRQAPGQGLEWMGWINPDSGGTDYSQRFQGR<br>VTMTRDTSISTAYMELSRLRSDDTAVYYCAREATI<br>FGMVIVPFDYWGQGTLVTVSS<br>SEQ ID NO: 265 |
| iPS:359737 | 13H12.005 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACAACCTCCTAAGCTGCTCATTTAC<br>TGGGCATCTACCCGGGAATCCGGGGTCCCTGAC<br>CGATTCAGTGGCAGCGGGTCTGGGACAGATTTC<br>ACTCTCACCATCAGCAGCCTGCAGGCTGAAGAT<br>GTGGCAGTTTTTTACTGTCAACAATATTATAGTA<br>CTCCGTGGACGTTCGGCCAAGGGACCAAGGTGG<br>AAATCAAACGA<br>SEQ ID NO: 1679 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGAAAGT<br>GGTGGCACAGACTATTCACAGAGGTTTCAGGGC<br>AGGGTCACCATGACCAGGGACACGTCCATCAGC<br>ACAGCCTACATGGAACTGAGCAGCCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1836 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | DIVMTQSPDSLAVSLGERATINCKSSQSVLSSSNNK<br>NYIAWYQQKPGQPPKLLIYWASTRESGVPDRFSGS<br>GSGTDFTLTISSLQAEDVAVFYCQQYYSTPWTFGQ<br>GTKVEIKR<br>SEQ ID NO: 109 | QVQLVQSGAEVKKPGASVKVSCKASGYTFTGYYI<br>HWVRQAPGQGLEWMGWINPESGGTDYSQRFQGR<br>VTMTRDTSISTAYMELSSLRSDDTAVYYCAREATI<br>FGMVIVPFDYWGQGTLVTVSS<br>SEQ ID NO: 266 |
| iPS:361326 | 13H12.006 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACAACCTCCTAAGCTGCTCATTTAC<br>TGGGCATCTACCCGGGAATCCGGGGTCCCTGAC<br>CGATTCAGTGGCAGCGGGTCTGGGACAGATTTC<br>ACTCTCACCATCAGCAGCCTGCAGGCTGAAGAT<br>GTGGCAGTTTTTTACTGTCAACAATATTATAGTA<br>CTCCGTGGACGTTCGGCCAAGGGACCAAGGTGG<br>AAATCAAACGA<br>SEQ ID NO: 1680 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGAAAGT<br>GGTGGCACAGACTATTCACAGAGGTTTCAGGGC<br>AGGGTCACCATGACCAGGGACACGTCCATCAGC<br>ACAGCCTACATGGAACTGAGCAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCA<br>SEQ ID NO: 1837 |
| | | AA | DIVMTQSPDSLAVSLGERATINCKSSQSVLSSSNNK<br>NYIAWYQQKPGQPPKLLIYWASTRESGVPDRFSGS<br>GSGTDFTLTISSLQAEDVAVFYCQQYYSTPWTFGQ<br>GTKVEIKR<br>SEQ ID NO: 110 | QVPLVQSGAEVKKPGASVKVSCKASGYTFTGYYI<br>HWVRQAPGQGLEWMGWINPESGGTDYSQRFQGR<br>VTMTRDTSISTAYMELSRLRSDDTAVYYCAREATI<br>FGMVIVPFDYWGQGTLVTVSS<br>SEQ ID NO: 267 |
| iPS:361330 | 12H11.002 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1681 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGAAACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1838 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 111 | QVPLVQSGAEVKKPGASVKVSCKASGYTFTGYYI<br>HWVRQAPGQGLEWMGWISPNQGETNYAQKFQD<br>RVTMTRDTSISTAYMELSRLRSDDTAVYYCAREA<br>TIFGMLIVPFDYWGQGTLVTVSS<br>SEQ ID NO: 268 |
| iPS:361337 | 12H11.003 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1682 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1839 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 112 | QVPLVQSGAEVKKPGASVKVSCKASGYTFTGYYI<br>HWVRQAPGQGLEWMGWISPNQGDTNYAQKFQD<br>RVTMTRDTSISTAYMELSRLRSDDTAVYYCAREA<br>TIFGMLIVPFDYWGQGTLVTVSS<br>SEQ ID NO: 269 |
| iPS:361344 | 12H11.004 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGAAACAAACTATGCACAGAAGTTTCAGGAC<br>AGGGTCACCATGACCAGGGACACGTCCATCAGC<br>ACAGCCTATATGGAGCTGAGCAGGCTGAGATCT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | GTGGCTGTTTATTACTGTCAGCAATATTATCGTA<br>CTCCGTGGACGTTCGGCCAAGGGACCAAGGTGG<br>AAATCAAACGA<br>SEQ ID NO: 1683 | GACGACACGGCCGTGTATTACTGTACGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1840 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 113 | QVPLVQSGAEVKKPGASVKVSCKASGYTFTGYYI<br>HWVRQAPGQGLEWMGWISPNQGETNYAQKFQD<br>RVTMTRDTSISTAYMELSRLRSDDTAVYYCTREA<br>TIFGMLIVPFDYWGQGTLVTVSS<br>SEQ ID NO: 270 |
| iPS:361351 | 12H11.005 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1684 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACAAT<br>GGTGAAACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1841 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 114 | QVPLVQSGAEVKKPGASVKVSCKASGYTFTGYYI<br>HWVRQAPGQGLEWMGWISPNNGETNYAQKFQD<br>RVTMTRDTSISTAYMELSRLRSDDTAVYYCAREA<br>TIFGMLIVPFDYWGQGTLVTVSS<br>SEQ ID NO: 271 |
| iPS:361358 | 12H11.006 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1685 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACAAT<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1842 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 115 | QVPLVQSGAEVKKPGASVKVSCKASGYTFTGYYI<br>HWVRQAPGQGLEWMGWISPNNGDTNYAQKFQD<br>RVTMTRDTSISTAYMELSRLRSDDTAVYYCAREA<br>TIFGMLIVPFDYWGQGTLVTVSS<br>SEQ ID NO: 272 |
| iPS:361365 | 12H11.007 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGA<br>SEQ ID NO: 1686 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTACGAGAGAG<br>GCCACGATTTTTGGAATGCTTATTGTACCATTTG<br>ACTACTGGGGCCAGGGAACCCTGGTCACCGTCT<br>CCTCA<br>SEQ ID NO: 1843 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKR<br>SEQ ID NO: 116 | QVPLVQSGAEVKKPGASVKVSCKASGYTFTGYYI<br>HWVRQAPGQGLEWMGWISPNQGDTNYAQKFQD<br>RVTMTRDTSISTAYMELSRLRSDDTAVYYCTREA<br>TIFGMLIVPFDYWGQGTLVTVSS<br>SEQ ID NO: 273 |
| iPS:361372 | 12H11.008 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1687 | ATACACTGGGTGCGTCAGGCCCCTGGACAAGGG CTTGAGTGGATGGGGTGGATAAGCCCTAACAAT GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTACGAGAGAG GCCACGATTTTTGGAATGCTTATTGTACCATTTG ACTACTGGGGCCAGGGAACCCTGGTCACCGTCT CCTCA SEQ ID NO: 1844 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKR SEQ ID NO: 117 | QVPLVQSGAEVKKPGASVKVSCKASGYTFTGYYI HWVRQAPGQGLEWMGWISPNNGETNYAQKFQD RVTMTRDTSISTAYMELSRLRSDDTAVYYCTREA TIFGMLIVPFDYWGQGTLVTVSS SEQ ID NO: 274 |
| iPS:361379 | 12H11.009 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1688 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1845 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKR SEQ ID NO: 118 | QVPLVQSGAEVKKPGASVKVSCKASGYTFTGYYI HWVRQAPGQGLEWMGWISPNQGETNYAQKFQD RVTMTRDTSISTAYMELSRLRSDDTAVYYCAREA TIFGMLIVPFDYWGQGTLVTVSS SEQ ID NO: 275 |
| iPS:361383 | 12H11.010 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1689 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGACACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1846 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKR SEQ ID NO: 119 | QVPLVQSGAEVKKPGASVKVSCKASGYTFTGYYI HWVRQAPGQGLEWMGWISPNNGDTNYAQKFQD RVTMTRDTSISTAYMELSRLRSDDTAVYYCAREA TIFGMLIVPFDYWGQGTLVTVSS SEQ ID NO: 276 |
| iPS:361387 | 12H11.011 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1690 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGACACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1847 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKR SEQ ID NO: 120 | QVPLVQSGAEVKKPGASVKVSCKASGYTFTGYYI HWVRQAPGQGLEWMGWISPNQGDTNYAQKFQD RVTMTRDTSISTAYMELSRLRSDDTAVYYCAREA TIFGMLIVPFDYWGQGTLVTVSS SEQ ID NO: 277 |
| iPS:361391 | 12H11.012 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1691 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1848 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKR SEQ ID NO: 121 | QVPLVQSGAEVKKPGASVKVSCKASGYTFTGYYI HWVRQAPGQGLEWMGWISPNNGETNYAQKFQD RVTMTRDTSISTAYMELSRLRSDDTAVYYCAREA TIFGMLIVPFDYWGQGTLVTVSS SEQ ID NO: 278 |
| iPS:361395 | 12H11.013 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAAACTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1692 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGCCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1849 |
| | | AA | DIVMTQSPDSLAVSLGERATINCKSSQSVLSSSNNK NYLAWYQQKPGQPPKLLIYWTSTRDSGVPDRFSG SGSGTDFTLTINSLQAEDVAVYYCQQYYRTPWTF GQGTKVEIKR SEQ ID NO: 122 | QVQLVQSGAEVKKPGASVKVSCKASGYTFTGYYI HWVRQAPGQGLEWMGWISPNQGETNYAQKFQD RVTMTRDTSISTAYMELSSLRSDDTAVYYCAREA TIFGMLIVPFDYWGQGTLVTVSS SEQ ID NO: 279 |
| iPS:361402 | 12H11.014 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAAACTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGA SEQ ID NO: 1693 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGCCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCA SEQ ID NO: 1850 |
| | | AA | DIVMTQSPDSLAVSLGERATINCKSSQSVLSSSNNK NYLAWYQQKPGQPPKLLIYWTSTRESGVPDRFSG SGSGTDFTLTINSLQAEDVAVYYCQQYYRTPWTF GQGTKVEIKR SEQ ID NO: 123 | QVQLVQSGAEVKKPGASVKVSCKASGYTFTGYYI HWVRQAPGQGLEWMGWISPNQGETNYAQKFQD RVTMTRDTSISTAYMELSSLRSDDTAVYYCAREA TIFGMLIVPFDYWGQGTLVTVSS SEQ ID NO: 280 |
| iPS:361406 | 2C2.005.001 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT |

TABLE 3-continued

Exemplary Variable Light and Variable Heavy Regions: Nucleic Acid ("NA") and Amino Acid ("AA") Sequences

| iPS# | Ab | Type | VL | VH |
| --- | --- | --- | --- | --- |
| | | | CAACATTCGATGAAAGCCTGAGTGGTCCGGTAT TCGGCGGAGGGACCAAGCTGACCGTCCTAGGT SEQ ID NO: 1694 | GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1851 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDESLSGPVFGGGTK LTVLG SEQ ID NO: 124 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 281 |
| iPS:361412 | 2C2.005. 002 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGCAAGGTCCGGTAT TCGGCGGAGGGACCAAGCTGACCGTCCTAGGT SEQ ID NO: 1695 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1852 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDESLQGPVFGGGTK LTVLG SEQ ID NO: 125 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 282 |
| iPS:361418 | 2C2.005. 003 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGAGTGGTCCGGTAT TCGGCGGAGGGACCAAGCTGACCGTCCTAGGT SEQ ID NO: 1696 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1853 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDESLSGPVFGGGTK LTVLG SEQ ID NO: 126 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 283 |
| iPS:361424 | 2C2.005. 004 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGCAAGGTCCGGTAT TCGGCGGAGGGACCAAGCTGACCGTCCTAGGT SEQ ID NO: 1697 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1854 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDESLQGPVFGGGTK LTVLG SEQ ID NO: 127 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 284 |
| iPS:361430 | 2C2.005. 005 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAATGGTCCGGTAT TCGGCGGAGGGACCAAGCTGACCGTCCTAGGT SEQ ID NO: 1698 | ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1855 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDDSLNGPVFGGGTK LTVLG SEQ ID NO: 128 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 285 |
| iPS:361436 | 2C2.005. 006 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAATGGTCCGGTAT TCGGCGGAGGGACCAAGCTGACCGTCCTAGGT SEQ ID NO: 1699 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1856 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDDSLNGPVFGGGTK LTVLG SEQ ID NO: 129 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 286 |
| iPS:361442 | 2C2.005. 007 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGAATGGTCCGGTAT TCGGCGGAGGGACCAAGCTGACCGTCCTAGGT SEQ ID NO: 1700 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1857 |
| | | AA | QSVLTQPPSASGTPGQRVTISCSGSSSNIGSNTVNW YQHLPGTAPKLLIYTNNQRPSGVPDRFSGSKSGTS ASLAISGLQSEDEADYFCATFDESLNGPVFGGGTK LTVLG SEQ ID NO: 130 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 287 |
| iPS:361448 | 2C2.005. 008 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGCAAGGTCCGGTAT TCGGCGGAGGGACCAAGCTGACCGTCCTAGGT SEQ ID NO: 1701 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1858 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDDSLQGPVFGGGTK<br>LTVLG<br>SEQ ID NO: 131 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSS<br>SEQ ID NO: 288 |
| iPS:361454 | 2C2.005.<br>009 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGACAGCCTGAGTGGTCCGGTAT<br>TCGGCGGAGGGACCAAGCTGACCGTCCTAGGT<br>SEQ ID NO: 1702 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCA<br>SEQ ID NO: 1859 |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDDSLSGPVFGGGTK<br>LTVLG<br>SEQ ID NO: 132 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSS<br>SEQ ID NO: 289 |
| iPS:361460 | 2C2.005.<br>010 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGACAGCCTGAATGCTCCGGTAT<br>TCGGCGGAGGGACCAAGCTGACCGTCCTAGGT<br>SEQ ID NO: 1703 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCA<br>SEQ ID NO: 1860 |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDDSLNAPVFGGGTK<br>LTVLG<br>SEQ ID NO: 133 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSS<br>SEQ ID NO: 290 |
| iPS:361466 | 2C2.005.<br>011 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATAGCAGCCTGAATGGTCCGGTAT<br>TCGGCGGAGGGACCAAGCTGACCGTCCTAGGT<br>SEQ ID NO: 1704 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCA<br>SEQ ID NO: 1861 |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDSSLNGPVFGGGTK<br>LTVLG<br>SEQ ID NO: 134 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSS<br>SEQ ID NO: 291 |
| iPS:361472 | 2C2.005.<br>012 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATTATG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | CAACATTCGATAGCAGCCTGAATGCTCCGGTAT TCGGCGGAGGGACCAAGCTGACCGTCCTAGGT SEQ ID NO: 1705 | GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1862 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDSSLNAPVFGGGTK LTVLG SEQ ID NO: 135 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 292 |
| iPS:361478 | 2C2.005. 013 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATAGCAGCCTGAATGCTCCGGTAT TCGGCGGAGGGACCAAGCTGACCGTCCTAGGT SEQ ID NO: 1706 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGCCTGAGGTCT GACGACACGGCCGTGTATTACTGTGCGAGAGGG GGGGATTACGTTTTCGGGACTTATCGGCCTCACT ACTACTACGGTATGGACGTCTGGGGCCAAGGGA CCACGGTCACCGTCTCCTCA SEQ ID NO: 1863 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDSSLNAPVFGGGTK LTVLG SEQ ID NO: 136 | QMQVVQSGAEVKKPGASVKVSCKASGYTFTGYY MHWVRQAPGQGLEWMGWINPNSGGTNYAQKFQ GRVTMTRDTSISTAYMELSSLRSDDTAVYYCARG GDYVFGTYRPHYYYGMDVWGQGTTVTVSS SEQ ID NO: 293 |
| iPS:361485 | 2C2.005. 014 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGAGTGGTCCGGTAT TCGGCGGAGGGACCAAGCTGACCGTCCTAGGT SEQ ID NO: 1707 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTTCGGGACTTATCGGCCTCACT ACTACTACGGTATGGACGTCTGGGGCCAAGGGA CCACGGTCACCGTCTCCTCA SEQ ID NO: 1864 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDESLSGPVFGGGTK LTVLG SEQ ID NO: 137 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVFGTYRPHYYYGMDVWGQGTTVTVSS SEQ ID NO: 294 |
| iPS:361845 | 18F2.013 | NA | GACATCCAGATGACCCAGTCTCCATCCTCCCTGT CTGCATCTATAGGAGACAGAGTCACCATCACTT GCCGGGCAAGTCAGGACCTTAGAAATTATTTAG GCTGGTATCAACAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1708 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCCCCAGGCAAGGGGC TGGAGTGGGTGGCAGTTATATGGTATGATGCAA GTAATGAAAACTATGCAGACGCCGTGAAGGGCC GATTCACCATCTCCAGAGACAATTCCAAGAACA CGCTGTATCTGCAAATGAACAGCCTGAGAGCCG AGGACACGGCTGTGTATTACTGTGCGAGAGATA GGACGATCTTTGGAGTGGTCTTGGGGGACTACT GGGGCCAGGGAACCCTGGTCACCGTCTCCTCA SEQ ID NO: 1865 |
| | | AA | DIQMTQSPSSLSASIGDRVTITCRASQDLRNYLGW YQQKPGKAPKRLIYGASSLQSGVPSRFSGSGSGTE FTLTISSLQPEDFATYYCLQHNNYPFTFGQGTKVDI KR SEQ ID NO: 138 | QVQLVESGGGVVQPGRSLRLSCAASGFTFSNFGM HWVRQAPGKGLEWVAVIWYDASNENYADAVKG RFTISRDNSKNTLYLQMNSLRAEDTAVYYCARDR TIFGVVLGDYWGQGTLVTVSS SEQ ID NO: 295 |
| iPS:361851 | 6H1.009 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGA SEQ ID NO: 1709 | TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATA GGACGATTTTTGGAGTGCTCTTGGGGGACTACT GGGGCCAGGGAACCCTGGTCACCGTCTCCTCA SEQ ID NO: 1866 |
| | | AA | DIQMTQSPSSLSASIGDRVTITCRASQDIRDYLGWY QQKPGKAPKRLIYGASSLQSGVPSRFSGSGSGTEFT LTISSLQPEDFATYYCLQHNNYPFTFGQGTKVDIK R SEQ ID NO: 139 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDR TIFGVLLGDYWGQGTLVTVSS SEQ ID NO: 296 |
| iPS:361855 | 2C2.005. 015 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCAACTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATAGCAGCCTGAGTGGTCCGGTAT TCGGCGGAGGGACCAAGCTGACCGTCCTAGGT SEQ ID NO: 1710 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCA SEQ ID NO: 1867 |
| | | AA | QSVLTQPPSASGTPGQRVTISCSGSSSNIGSNTVNW YQQLPGTAPKLLIYTNNQRPSGVPDRFSGSKSGTS ASLAISGLQSEDEADYFCATFDSSLSGPVFGGGTK LTVLG SEQ ID NO: 140 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSS SEQ ID NO: 297 |
| iPS:336067 | 5G12.006 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCACACGA SEQ ID NO: 1711 | CAGGTGCAGTTGGTGGAGTCTGGGGGAGGCGTG GTCCAGCCTGGGAGGTCCCTGAGACTCTCCTGT ACAGCGTCTGGATTCACCTTCAGTAGCTATGGC ATACACTGGGTCCGCCAGGCTCCAGGCAAGGGG CTGGAGTGGGTGGCAGTTATATGGTATGATGGA AGTAATAAGTTCCATGCAGACTCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1868 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEITR SEQ ID NO: 141 | QVQLVESGGGVVQPGRSLRLSCTASGFTFSSYGIH WVRQAPGKGLEWVAVIWYDGSNKFHADSVKGRF TISRDNSKNTLYLQMNSLRAEDSAMYFCARGKVA GMPEAFEIWGQGTKVTVSS SEQ ID NO: 298 |
| iPS:336169 | 17B11.002 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATGAGCAGTTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG T SEQ ID NO: 1712 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTAACACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCA SEQ ID NO: 1869 |
| | | AA | QSVLTQPPSVSAAPGQKVTISCSGSSSNIGNNYVS WYEQFPGTAPKLLIYDNNKRPSGIPDRFSGSKSGTS ATLGITGLQTGDEADYYCGTWDSSLSAVVFGGGT KLTVLG SEQ ID NO: 142 | QMQLVQSGAEVKKPGASVKVSCKASGYTFTSYDI NWVRQATGQGLEWMGWMNPNSGNTGYAQKFQ GRVTMTRDTSISTAYMELSSLRSQDTAVYYCARG GDYVWGSYRPYYYYYGMDVWGQGTTVTVSS SEQ ID NO: 299 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| iPS:361127 | 5G12.006.001 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGA SEQ ID NO: 1713 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1870 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR SEQ ID NO: 143 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTKVTVSS SEQ ID NO: 300 |
| iPS:361136 | 5G12.006.002 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGA SEQ ID NO: 1714 | CAGGTGCAGTTGGTGGAGTCTGGGGGAGGCGTG GTCCAGCCTGGGAGGTCCCTGAGACTCTCCTGT ACAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1871 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR SEQ ID NO: 144 | QVQLVESGGGVVQPGRSLRLSCTASGFTFSSYGIH WVRQAPGKGLEWVAVIWYDASNKFHADAVKGR FTISRDNSKNTLYLQMNSLRAEDSAMYFCARGKV AGMPEAFEIWGQGTKVTVSS SEQ ID NO: 301 |
| iPS:361140 | 5G12.006.003 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCACACGA SEQ ID NO: 1715 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1872 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEITR SEQ ID NO: 145 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTKVTVSS SEQ ID NO: 302 |
| iPS:359919 | 5G12.006.004 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTA AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGA SEQ ID NO: 1716 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACATTGGTCACCGTCTCTTCA SEQ ID NO: 1873 |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | AA | DIQLTQSPSSLSASVGDRVTITCRASQTISRFLNWY QQKPGKAPKLLIYVASSLQSGVPSRFSGSGSGTDF TLTISSLQPEDFATYYCQQSYSTLISFGQGTKLEIK R SEQ ID NO: 146 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTLVTVSS SEQ ID NO: 303 |
| iPS:361144 | 5G12.006. 005 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGA SEQ ID NO: 1717 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACTCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1874 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR SEQ ID NO: 147 | QVQLVESGGGVVQPGRSLRLSCAASGFTFSSYGIH WVRQAPGKGLEWVAVIWYDASNKFHADSVKGRF TISRDNSKNTLYLQMNSLRAEDSAMYFCARGKVA GMPEAFEIWGQGTKVTVSS SEQ ID NO: 304 |
| iPS:361151 | 5G12.006. 006 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGA SEQ ID NO: 1718 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGGA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA SEQ ID NO: 1875 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR SEQ ID NO: 148 | QVQLVESGGGVVQPGRSLRLSCAASGFTFSSYGIH WVRQAPGKGLEWVAVIWYDGSNKFHADAVKGR FTISRDNSKNTLYLQMNSLRAEDSAMYFCARGKV AGMPEAFEIWGQGTKVTVSS SEQ ID NO: 305 |
| iPS:361491 | 17B11. 002.001 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG T SEQ ID NO: 1719 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCA SEQ ID NO: 1876 |
| | | AA | QSVLTQPPSVSAAPGQKVTISCSGSSSNIGNNYVS WYQQLPGTAPKLLIYDNNKRPSGIPDRFSGSKSGT SATLGITGLQTGDEADYYCGTWDSSLSAVVFGGG TKLTVLG SEQ ID NO: 149 | QMQLVQSGAEVKKPGASVKVSCKASGYTFTSYDI NWVRQATGQGLEWMGWMNPNSGGTGYAQKFQ GRVTMTRDTSISTAYMELSSLRSQDTAVYYCARG GDYVWGSYRPYYYYYGMDVWGQGTTVTVSS SEQ ID NO: 306 |
| iPS:361499 | 17B11. 002.002 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTAACACAGGCTATGCACAGAAGTTCCAGGGC AGAGTCACCATGACCAGGGACACCTCCATAAGC ACAGCCTACATGGAGCTGAGCAGCCTGAGATCT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | CGGAACATGGGATAGCAGCCTGAGTGCTGTGGT<br>ATTCGGCGGAGGGACCAAACTGACCGTCCTAGG<br>T<br>SEQ ID NO: 1720 | CAGGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCA<br>SEQ ID NO: 1877 |
| | | AA | QSVLTQPPSVSAAPGQKVTISCSGSSSNIGNNYVS<br>WYQQLPGTAPKLLIYDNNKRPSGIPDRFSGSKSGT<br>SATLGITGLQTGDEADYYCGTWDSSLSAVVFGGG<br>TKLTVLG<br>SEQ ID NO: 150 | QMQLVQSGAEVKKPGASVKVSCKASGYTFTSYDI<br>NWVRQATGQGLEWMGWMNPNSGNTGYAQKFQ<br>GRVTMTRDTSISTAYMELSSLRSQDTAVYYCARG<br>GDYVWGSYRPYYYYYGMDVWGQGTTVTVSS<br>SEQ ID NO: 307 |
| iPS:361503 | 17B11.<br>002.003 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATGAGCAGTTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGGCATCACCGG<br>ACTCCAGACTGGGGACGAGGCCGATTATTACTG<br>CGGAACATGGGATAGCAGCCTGAGTGCTGTGGT<br>ATTCGGCGGAGGGACCAAACTGACCGTCCTAGG<br>T<br>SEQ ID NO: 1721 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCACTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>CAGGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCA<br>SEQ ID NO: 1878 |
| | | AA | QSVLTQPPSVSAAPGQKVTISCSGSSSNIGNNYVS<br>WYEQFPGTAPKLLIYDNNKRPSGIPDRFSGSKSGTS<br>ATLGITGLQTGDEADYYCGTWDSSLSAVVFGGGT<br>KLTVLG<br>SEQ ID NO: 151 | QMQLVQSGAEVKKPGASVKVSCKASGYTFTSYDI<br>NWVRQATGQGLEWMGWMNPNSGGTGYAQKFQ<br>GRVTMTRDTSISTAYMELSSLRSQDTAVYYCARG<br>GDYVWGSYRPYYYYYGMDVWGQGTTVTVSS<br>SEQ ID NO: 308 |
| iPS:361507 | 17B11.<br>002.004 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGCCATCACCGG<br>ACTCCAGACTGGGGACGAGGCCGATTATTACTG<br>CGGAACATTCGAAAGCAGCCTGAGTGCTGTGGT<br>ATTCGGCGGAGGGACCAAACTGACCGTCCTAGG<br>T<br>SEQ ID NO: 1722 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCCCTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>GACGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCA<br>SEQ ID NO: 1879 |
| | | AA | QSVLTQPPSVSAAPGQKVTISCSGSSSNIGNNYVS<br>WYQQLPGTAPKLLIYDNNKRPSGIPDRFSGSKSGT<br>SATLAITGLQTGDEADYYCGTFESSLSAVVFGGGT<br>KLTVLG<br>SEQ ID NO: 152 | QMQLVQSGAEVKKPGASVKVSCKASGYTFTSYDI<br>NWVRQAPGQGLEWMGWMNPNSGGTGYAQKFQ<br>GRVTMTRDTSISTAYMELSSLRSDDTAVYYCARG<br>GDYVWGSYRPYYYYYGMDVWGQGTTVTVSS<br>SEQ ID NO: 309 |
| iPS:361514 | 17B11.<br>002.005 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGCCATCACCGG<br>ACTCCAGACTGGGGACGAGGCCGATTATTACTG<br>CGGAACATGGGATAGCAGCCTGAGTGCTGTGGT<br>ATTCGGCGGAGGGACCAAACTGACCGTCCTAGG<br>T<br>SEQ ID NO: 1723 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCACTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>CAGGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCA<br>SEQ ID NO: 1880 |
| | | AA | QSVLTQPPSVSAAPGQKVTISCSGSSSNIGNNYVS<br>WYQQLPGTAPKLLIYDNNKRPSGIPDRFSGSKSGT<br>SATLAITGLQTGDEADYYCGTWDSSLSAVVFGGG<br>TKLTVLG<br>SEQ ID NO: 153 | QMQLVQSGAEVKKPGASVKVSCKASGYTFTSYDI<br>NWVRQATGQGLEWMGWMNPNSGGTGYAQKFQ<br>GRVTMTRDTSISTAYMELSSLRSQDTAVYYCARG<br>GDYVWGSYRPYYYYYGMDVWGQGTTVTVSS<br>SEQ ID NO: 310 |
| iPS:360582 | 17B11.<br>002.006 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT |

TABLE 3-continued

Exemplary Variable Light and Variable Heavy Regions: Nucleic Acid ("NA") and Amino Acid ("AA") Sequences

| iPS# | Ab | Type | VL | VH |
|---|---|---|---|---|
| | | | TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGCCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG T SEQ ID NO: 1724 | ATCAACTGGGTGCGACAGGCCCCTGGACAAGGG CTTGAGTGGATGGGATGGATGAACCCTAACAGT GGTAACACAGGCTATGCACAGAAGTTCCAGGGC AGAGTCACCATGACCAGGGACACCTCCATAAGC ACAGCCTACATGGAGCTGAGCAGCCTGAGATCT GACGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCA SEQ ID NO: 1881 |
| | | AA | QSVLTQPPSVSAAPGQKVTISCSGSSSNIGNNYVS WYQQLPGTAPKLLIYDNNKRPSGIPDRFSGSKSGT SATLAITGLQTGDEADYYCGTWDSSLSAVVFGGG TKLTVLG SEQ ID NO: 154 | QMQLVQSGAEVKKPGASVKVSCKASGYTFTSYDI NWVRQAPGQGLEWMGWMNPNSGNTGYAQKFQ GRVTMTRDTSISTAYMELSSLRSDDTAVYYCARG GDYVWGSYRPYYYYYGMDVWGQGTTVTVSS SEQ ID NO: 311 |
| iPS:361518 | 17B11. 002.007 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG T SEQ ID NO: 1725 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTTCGGGAGTTATCGTCCCTACT ACTACTACTACGGTATGGACGTCTGGGGCCAAG GGACCACGGTCACCGTCTCCTCA SEQ ID NO: 1882 |
| | | AA | QSVLTQPPSVSAAPGQKVTISCSGSSSNIGNNYVS WYQQLPGTAPKLLIYDNNKRPSGIPDRFSGSKSGT SATLGITGLQTGDEADYYCGTWDSSLSAVVFGGG TKLTVLG SEQ ID NO: 155 | QMQLVQSGAEVKKPGASVKVSCKASGYTFTSYDI NWVRQATGQGLEWMGWMNPNSGGTGYAQKFQ GRVTMTRDTSISTAYMELSSLRSQDTAVYYCARG GDYVFGSYRPYYYYYGMDVWGQGTTVTVSS SEQ ID NO: 312 |
| iPS:360570 | 17B11. 002.008 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGCCATCACCGG ACTCCAGACTGGGGACGAGGCCGATTATTACTG CGGAACATTCGAAAGCAGCCTGAGTGCTGTGGT ATTCGGCGGAGGGACCAAACTGACCGTCCTAGG T SEQ ID NO: 1726 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCCCTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT GACGACACGGCCGTGTATTACTGTGCGAGAGGG GGTGATTACGTTTTCGGGAGTTATCGTCCCTACT ACTACTACTACGGTATGGACGTCTGGGGCCAAG GGACCACGGTCACCGTCTCCTCA SEQ ID NO: 1883 |
| | | AA | QSVLTQPPSVSAAPGQKVTISCSGSSSNIGNNYVS WYQQLPGTAPKLLIYDNNKRPSGIPDRFSGSKSGT SATLAITGLQTGDEADYYCGTFESSLSAVVFGGGT KLTVLG SEQ ID NO: 156 | QMQLVQSGAEVKKPGASVKVSCKASGYTFTSYDI NWVRQAPGQGLEWMGWMNPNSGGTGYAQKFQ GRVTMTRDTSISTAYMELSSLRSDDTAVYYCARG GDYVFGSYRPYYYYYGMDVWGQGTTVTVSS SEQ ID NO: 313 |
| iPS:362051 | 5G12. 005.001 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTA AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGCTCAGTTTTGGCCA GGGGACCAAGCTGGAGATCAAACGA SEQ ID NO: 1727 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACATTGGTCACCGTCTCTTCA SEQ ID NO: 1884 |

TABLE 3-continued

| Exemplary Variable Light and Variable Heavy Regions: Nucleic Acid ("NA") and Amino Acid ("AA") Sequences | | | | |
|---|---|---|---|---|
| iPS# | Ab | Type | VL | VH |
| | | AA | DIQLTQSPSSLSASVGDRVTITCRASQTISRFLNWY QQKPGKAPKLLIYVASSLQSGVPSRFSGSGSGTDF TLTISSLQPEDFATYYCQQSYSTLLSFGQGTKLEIK R SEQ ID NO: 157 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTLVTVSS SEQ ID NO: 314 |

Table 4. Exemplary CDRL1, CDRL2, CDRL3, CDRH1, CDRH2, and CDRH3 Nucleic Acid ("NA") and Amino Acid ("AA") Sequences

TABLE 4A

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:336175 | 2C2.005 | NA | TCTGGAAGTAGCTCCAACATCG GAAGTAATACTGTAAAC SEQ ID NO: 2199 | ACTAATAATCAGCGGCCCTCA SEQ ID NO: 2356 | GCAACATTCGATGACAGCCTG AATGGTCCGGTA SEQ ID NO: 2513 |
| | | AA | SGSSSNIGSNTVN SEQ ID NO: 629 | TNNQRPS SEQ ID NO: 786 | ATFDDSLNGPV SEQ ID NO: 943 |
| iPS:335914 | 4B1 | NA | CGGGCAAGTCAGGACATTAGAG ATTATTTAGGC SEQ ID NO: 2200 | GGTGCATCCAGTTTGCAAAGT SEQ ID NO: 2357 | CTACAGCATAATAATTACCCCT TCACT SEQ ID NO: 2514 |
| | | AA | RASQDIRDYLG SEQ ID NO: 630 | GASSLQS SEQ ID NO: 787 | LQHNNYPFT SEQ ID NO: 944 |
| iPS:335938 | 6H1 | NA | CGGGCAAGTCAGGACATTAGAG ATTATTTAGGC SEQ ID NO: 2201 | GGTGCATCCAGTTTGCAAAGT SEQ ID NO: 2358 | CTACAGCATAATAATTACCCCT TCACT SEQ ID NO: 2515 |
| | | AA | RASQDIRDYLG SEQ ID NO: 631 | GASSLQS SEQ ID NO: 788 | LQHNNYPFT SEQ ID NO: 945 |
| iPS:335941 | 2F11 | NA | CAGGCGAGTCAGGACATTAGCA ACTATTTAAAT SEQ ID NO: 2202 | GATGCATCCAATTTGGAAACA SEQ ID NO: 2359 | CAACAGTATGATATTCTCCTCA CT SEQ ID NO: 2516 |
| | | AA | QASQDISNYLN SEQ ID NO: 632 | DASNLET SEQ ID NO: 789 | QQYDILLT SEQ ID NO: 946 |
| iPS:335970 | 5C2 | NA | AAGTCCAGCCAGAGTGTTTTAT CCAGCTCCAACAATAAGAACTA CATAGCT SEQ ID NO: 2203 | TGGGCATCTACCCGGGAATCC SEQ ID NO: 2360 | CAACAATATTATAGTACTCCGT GGACG SEQ ID NO: 2517 |
| | | AA | KSSQSVLSSSNNKNYIA SEQ ID NO: 633 | WASTRES SEQ ID NO: 790 | QQYYSTPWT SEQ ID NO: 947 |
| iPS:335978 | 13H12 | NA | AAGTCCAGCCAGAGTGTTTTAT CCAGCTCCAACAATAAGAACTA CATAGCT SEQ ID NO: 2204 | TGGGCATCTACCCGGGAATCC SEQ ID NO: 2361 | CAACAATATTATAGTACTCCGT GGACG SEQ ID NO: 2518 |
| | | AA | KSSQSVLSSSNNKNYIA SEQ ID NO: 634 | WASTRES SEQ ID NO: 791 | QQYYSTPWT SEQ ID NO: 948 |
| iPS:335986 | 11C1 | NA | AAGTCCAGCCAGAGTGTTTTAT CCAGCTCCAACAATAAGAACTA CTTAGCT SEQ ID NO: 2205 | TGGACTTCTACCCGAGATTCC SEQ ID NO: 2362 | CAGCAATATTATCGTACTCCGT GGACG SEQ ID NO: 2519 |
| | | AA | KSSQSVLSSSNNKNYLA SEQ ID NO: 635 | WTSTRDS SEQ ID NO: 792 | QQYYRTPWT SEQ ID NO: 949 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:335994 | 12H11 | NA | AAGTCCAGCCAGAGTGTTTTAT CCAGCTCCAACAATAAGAACTA CTTAGCT SEQ ID NO: 2206 | TGGACTTCTACCCGAGATTCC SEQ ID NO: 2363 | CAGCAATATTATCGTACTCCGT GGACG SEQ ID NO: 2520 |
| | | AA | KSSQSVLSSSNNKNYLA SEQ ID NO: 636 | WTSTRDS SEQ ID NO: 793 | QQYYRTPWT SEQ ID NO: 950 |
| iPS:336024 | 18E3 | NA | AGGGCCAGTCAGAGTATTAGTT ACAGTTACTTAGCC SEQ ID NO: 2207 | GGTGCATCCAGCAGGGCCACT SEQ ID NO: 2364 | CAGCAGTATGGTAGTTCACCGC TCACT SEQ ID NO: 2521 |
| | | AA | RASQSISYSYLA SEQ ID NO: 637 | GASSRAT SEQ ID NO: 794 | QQYGSSPLT SEQ ID NO: 951 |
| iPS:336041 | 2G10_LC1 | NA | AGGGCCAGTCAGAGTGTTAGCA GCAACTTAGCC SEQ ID NO: 2208 | GGTGCAGCCACCAGGGCCACT SEQ ID NO: 2365 | CAGCAGTATAATAACTGGCCTC TCACT SEQ ID NO: 2522 |
| | | AA | RASQSVSSNLA SEQ ID NO: 638 | GAATRAT SEQ ID NO: 795 | QQYNNWPLT SEQ ID NO: 952 |
| iPS:336077 | 4H9.004 | NA | CGGGCAAGTCAGGGCATTAGAA ATGAGTTAGGC SEQ NO: 2209 | GGTGCATCCAGTTTGCAAAGT SEQ ID NO: 2366 | CTACAGCATAATAGTTACCCAT TCACT SEQ ID NO: 2523 |
| | | AA | RASQGIRNELG SEQ ID NO: 639 | GASSLQS SEQ ID NO: 796 | LQHNSYPFT SEQ ID NO: 953 |
| iPS:336088 | 6A5.044 | NA | CAGGCGAGTCAGGACATTACCA ACTATTTAAAT SEQ ID NO: 2210 | GATGCTTCCAATTTGGAGCCA SEQ ID NO: 2367 | CAACAGTATGATGATCTATTCA CT SEQ ID NO: 2524 |
| | | AA | QDITNYLN SEQ ID NO: 640 | DASNLEP SEQ ID NO: 797 | QQYDDLFT SEQ ID NO: 954 |
| iPS:336099 | 17H11.004 | NA | CGGGCGAGTCAGGGTCTTATCA TCTGGTTAGCC SEQ ID NO: 2211 | GCTGCATCCAGTTTGCAAAGT SEQ ID NO: 2368 | CAACAGACTAACAGTTTCCCTC CGACG SEQ ID NO: 2525 |
| | | AA | RASQGLIIWLA SEQ ID NO: 641 | AASSLQS SEQ ID NO: 798 | QQTNSFPPT SEQ ID NO: 955 |
| iPS:359621 | 17H11.004.001 | NA | CGGGCGAGTCAGGGTCTTATCA TCTGGTTAGCC SEQ ID NO: 2212 | GCTGCATCCAGTTTGCAAAGT SEQ ID NO: 2369 | CAACAGACTAACAGTTTCCCTC CGACG SEQ ID NO: 2526 |
| | | AA | RASQGLIIWLA SEQ ID NO: 642 | AASSLQS SEQ ID NO: 799 | QQTNSFPPT SEQ ID NO: 956 |
| iPS:359781 | 4H9.004.001 | NA | CGGGCAAGTCAGGGCATTAGAA ATGAGTTAGGC SEQ ID NO: 2213 | GGTGCATCCAGTTTGCAAAGT SEQ ID NO: 2370 | CTACAGCATAATAGTTACCCAT TCACT SEQ ID NO: 2527 |
| | | AA | RASQGIRNELG SEQ ID NO: 643 | GASSLQS SEQ ID NO: 800 | LQHNSYPFT SEQ ID NO: 957 |
| iPS:360929 | 4H9.004.002 | NA | CGGGCAAGTCAGGGCATTAGAA ATGAGTTAGGC SEQ ID NO: 2214 | GGTGCATCCAGTTTGCAAAGT SEQ ID NO: 2371 | CTACAGCATAATAGTTACCCAT TCACT SEQ ID NO: 2528 |
| | | AA | RASQGIRNELG SEQ ID NO: 644 | GASSLQS SEQ ID NO: 801 | LQHNSYPFT SEQ ID NO: 958 |
| iPS:360936 | 4H9.004.003 | NA | CGGGCAAGTCAGGGCATTAGAA ATGAGTTAGGC SEQ ID NO: 2215 | GGTGCATCCAGTTTGCAAAGT SEQ ID NO: 2372 | CTACAGCATAATAGTTACCCAT TCACT SEQ ID NO: 2529 |
| | | AA | RASQGIRNELG SEQ ID NO: 645 | GASSLQS SEQ ID NO: 802 | LQHNSYPFT SEQ ID NO: 959 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:360943 | 4H9.004.004 | NA | CGGGCAAGTCAGGGCATTAGAAATGAGTTAGGC<br>SEQ ID NO: 2216 | GGTGCATCCAGTTTGCAAAGT<br>SEQ ID NO: 2373 | CTACAGCATAATAGTTACCCATTCACT<br>SEQ ID NO: 2530 |
| | | AA | RASQGIRNELG<br>SEQ ID NO: 646 | GASSLQS<br>SEQ ID NO: 803 | LQHNSYPFT<br>SEQ ID NO: 960 |
| iPS:360949 | 4H9.004.005 | NA | CGGGCAAGTCAGGGCATTAGAAATGAGTTAGGC<br>SEQ ID NO: 2217 | GGTGCATCCAGTTTGCAAAGT<br>SEQ ID NO: 2374 | CTACAGCATAATAGTTACCCATTCACT<br>SEQ ID NO: 2531 |
| | | AA | RASQGIRNELG<br>SEQ ID NO: 647 | GASSLQS<br>SEQ ID NO: 804 | LQHNSYPFT<br>SEQ ID NO: 961 |
| iPS:359761 | 4H9.004.006 | NA | CGGGCAAGTCAGGGCATTAGAAATGAGTTAGGC<br>SEQ ID NO: 2218 | GGTGCATCCAGTTTGCAAAGT<br>SEQ ID NO: 2375 | CTACAGCATAATAGTTACCCATTCACT<br>SEQ ID NO: 2532 |
| | | AA | RASQGIRNELG<br>SEQ ID NO: 648 | GASSLQS<br>SEQ ID NO: 805 | LQHNSYPFT<br>SEQ ID NO: 962 |
| iPS:360955 | 4B1.010 | NA | CGGGCAAGTCAGGACATTAGAGATTATTTAGGC<br>SEQ ID NO: 2219 | GGTGCATCCAGTTTGCAAAGT<br>SEQ ID NO: 2376 | CTACAGCATAATAATTACCCCTTCACT<br>SEQ ID NO: 2533 |
| | | AA | ASQDIRDYLG<br>SEQ ID NO: 649 | GASSLQS<br>SEQ ID NO: 806 | LQHNNYPFT<br>SEQ ID NO: 963 |
| iPS:360962 | 4B1.011 | NA | CGGGCAAGTCAGGACATTAGAGATTATTTAGGC<br>SEQ ID NO: 2220 | GGTGCATCCAGTTTGCAAAGT<br>SEQ ID NO: 2377 | CTACAGCATAATAATTACCCCTTCACT<br>SEQ ID NO: 2534 |
| | | AA | RASQDIRDYLG<br>SEQ ID NO: 650 | GASSLQS<br>SEQ ID NO: 807 | LQHNNYPFT<br>SEQ ID NO: 964 |
| iPS:360968 | 4B1.012 | NA | CGGGCAAGTCAGGACATTAGAGATTATTTAGGC<br>SEQ ID NO: 2221 | GGTGCATCCAGTTTGCAAAGT<br>SEQ ID NO: 2378 | CTACAGCATAATAATTACCCCTTCACT<br>SEQ ID NO: 2535 |
| | | AA | RASQDIRDYLG<br>SEQ ID NO: 651 | GASSLQS<br>SEQ ID NO: 808 | LQHNNYPFT<br>SEQ ID NO: 965 |
| iPS:360974 | 4B1.013 | NA | CGGGCAAGTCAGGACATTAGAGATTATTTAGGC<br>SEQ ID NO: 2222 | GGTGCATCCAGTTTGCAAAGT<br>SEQ ID NO: 2379 | CTACAGCATAATAATTACCCCTTCACT<br>SEQ ID NO: 2536 |
| | | AA | RASQDIRDYLG<br>SEQ ID NO: 652 | GASSLQS<br>SEQ ID NO: 809 | LQHNNYPFT<br>SEQ ID NO: 966 |
| iPS:360978 | 4B1.014 | NA | CGGGCAAGTCAGGACATTAGAGATTATTTAGGC<br>SEQ ID NO: 2223 | GGTGCATCCAGTTTGCAAAGT<br>SEQ ID NO: 2380 | CTACAGCATAATAATTACCCCTTCACT<br>SEQ ID NO: 2537 |
| | | AA | RASQDIRDYLG<br>SEQ ID NO: 653 | GASSLQS<br>SEQ ID NO: 810 | LQHNNYPFT<br>SEQ ID NO: 967 |
| iPS:359785 | 4B1.015 | NA | CGGGCAAGTCAGGACATTAGAGATTATTTAGGC<br>SEQ ID NO: 2224 | GGTGCATCCAGTTTGCAAAGT<br>SEQ ID NO: 2381 | CTACAGCATAATAATTACCCCTTCACT<br>SEQ ID NO: 2538 |
| | | AA | RASQDIRDYLG<br>SEQ ID NO: 654 | GASSLQS<br>SEQ ID NO: 811 | LQHNNYPFT<br>SEQ ID NO: 968 |
| iPS:360982 | 4B1.016 | NA | CGGGCAAGTCAGGACATTAGAGATTATTTAGGC<br>SEQ ID NO: 2225 | GGTGCATCCAGTTTGCAAAGT<br>SEQ ID NO: 2382 | CTACAGCATAATAATTACCCCTTCACT<br>SEQ ID NO: 2539 |
| | | AA | RASQDIRDYLG<br>SEQ ID NO: 655 | GASSLQS<br>SEQ ID NO: 812 | LQHNNYPFT<br>SEQ ID NO: 969 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:335922 | 18F2 | NA | CGGGCAAGTCAGGACCTTAGAA ATTATTTAGGC SEQ ID NO: 2226 | GGTGCATCCAGTTTGCAAAGT SEQ ID NO: 2383 | CTACAGCATAATAATTACCCCT TCACT SEQ ID NO: 2540 |
| | | AA | RASQDLRNYLG SEQ ID NO: 656 | GASSLQS SEQ ID NO: 813 | LQHNNYPFT SEQ ID NO: 970 |
| iPS:360986 | 18F2.002 | NA | CGGGCAAGTCAGGACCTTAGAA ATTATTTAGGC SEQ ID NO: 2227 | GGTGCATCCAGTTTGCAAAGT SEQ ID NO: 2384 | CTACAGCATAATAATTACCCCT TCACT SEQ ID NO: 2541 |
| | | AA | RASQDLRNYLG SEQ ID NO: 657 | GASSLQS SEQ ID NO: 814 | LQHNNYPFT SEQ ID NO: 971 |
| iPS:360995 | 18F2.003 | NA | CGGGCAAGTCAGGACCTTAGAA ATTATTTAGGC SEQ ID NO: 2228 | GGTGCATCCAGTTTGCAAAGT SEQ ID NO: 2385 | CTACAGCATAATAATTACCCCT TCACT SEQ ID NO: 2542 |
| | | AA | RASQDLRNYLG SEQ ID NO: 658 | GASSLQS SEQ ID NO: 815 | LQHNNYPFT SEQ ID NO: 972 |
| iPS:360999 | 18F2.004 | NA | CGGGCAAGTCAGGACCTTAGAA ATTATTTAGGC SEQ ID NO: 2229 | GGTGCATCCAGTTTGCAAAGT SEQ ID NO: 2386 | CTACAGCATAATAATTACCCCT TCACT SEQ ID NO: 2543 |
| | | AA | RASQDLRNYLG SEQ ID NO: 659 | GASSLQS SEQ ID NO: 816 | LQHNNYPFT SEQ ID NO: 973 |
| iPS:361005 | 18F2.005 | NA | CGGGCAAGTCAGGACCTTAGAA ATTATTTAGGC SEQ ID NO: 2230 | GGTGCATCCAGTTTGCAAAGT SEQ ID NO: 2387 | CTACAGCATAATAATTACCCCT TCACT SEQ ID NO: 2544 |
| | | AA | RASQDLRNYLG SEQ ID NO: 660 | GASSLQS SEQ ID NO: 817 | LQHNNYPFT SEQ ID NO: 974 |
| iPS:361009 | 18F2.006 | NA | CGGGCAAGTCAGGACCTTAGAA ATTATTTAGGC SEQ ID NO: 2231 | GGTGCATCCAGTTTGCAAAGT SEQ ID NO: 2388 | CTACAGCATAATAATTACCCCT TCACT SEQ ID NO: 2545 |
| | | AA | RASQDLRNYLG SEQ ID NO: 661 | GASSLQS SEQ ID NO: 818 | LQHNNYPFT SEQ ID NO: 975 |
| iPS:361013 | 18F2.007 | NA | CGGGCAAGTCAGGACCTTAGAA ATTATTTAGGC SEQ ID NO: 2232 | GGTGCATCCAGTTTGCAAAGT SEQ ID NO: 2389 | CTACAGCATAATAATTACCCCT TCACT SEQ ID NO: 2546 |
| | | AA | RASQDLRNYLG SEQ ID NO: 662 | GASSLQS SEQ ID NO: 819 | LQHNNYPFT SEQ ID NO: 976 |
| iPS:361017 | 18F2.008 | NA | CGGGCAAGTCAGGACCTTAGAA ATTATTTAGGC SEQ ID NO: 2233 | GGTGCATCCAGTTTGCAAAGT SEQ ID NO: 2390 | CTACAGCATAATAATTACCCCT TCACT SEQ ID NO: 2547 |
| | | AA | RASQDLRNYLG SEQ ID NO: 663 | GASSLQS SEQ ID NO: 820 | LQHNNYPFT SEQ ID NO: 977 |
| iPS:361021 | 18F2.009 | NA | CGGGCAAGTCAGGACCTTAGAA ATTATTTAGGC SEQ ID NO: 2234 | GGTGCATCCAGTTTGCAAAGT SEQ ID NO: 2391 | CTACAGCATAATAATTACCCCT TCACT SEQ ID NO: 2548 |
| | | AA | RASQDLRNYLG SEQ ID NO: 664 | GASSLQS SEQ ID NO: 821 | LQHNNYPFT SEQ ID NO: 978 |
| iPS:361028 | 18F2.010 | NA | CGGGCAAGTCAGGACCTTAGAA ATTATTTAGGC SEQ ID NO: 2235 | GGTGCATCCAGTTTGCAAAGT SEQ ID NO: 2392 | CTACAGCATAATAATTACCCCT TCACT SEQ ID NO: 2549 |
| | | AA | RASQDLRNYLG SEQ ID NO: 665 | GASSLQS SEQ ID NO: 822 | LQHNNYPFT SEQ ID NO: 979 |
| iPS:360535 | 18F2.011 | NA | CGGGCAAGTCAGGACCTTAGAA ATTATTTAGGC SEQ ID NO: 2236 | GGTGCATCCAGTTTGCAAAGT SEQ ID NO: 2393 | CTACAGCATAATAATTACCCCT TCACT SEQ ID NO: 2550 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| | | AA | RASQDLRNYLG SEQ ID NO: 666 | GASSLQS SEQ ID NO: 823 | LQHNNYPFT SEQ ID NO: 980 |
| iPS:361035 | 18F2.012 | NA | CGGGCAAGTCAGGACCTTAGAA ATTATTTAGGC SEQ ID NO: 2237 | GGTGCATCCAGTTTGCAAAGT SEQ ID NO: 2394 | CTACAGCATAATAATTACCCCT TCACT SEQ ID NO: 2551 |
| | | AA | RASQDLRNYLG SEQ ID NO: 667 | GASSLQS SEQ ID NO: 824 | LQHNNYPFT SEQ ID NO: 981 |
| iPS:359940 | 2F11.002 | NA | CAGGCGAGTCAGGACATTAGCA ACTATTTAAAT SEQ ID NO: 2238 | GATGCATCCAATTTGGAAACA SEQ ID NO: 2395 | CAACAGTATGATATTCTCCTCA CT SEQ ID NO: 2552 |
| | | AA | QASQDISNYLN SEQ ID NO: 668 | DASNLET SEQ ID NO: 825 | QQYDILLT SEQ ID NO: 982 |
| iPS:361039 | 2F11.003 | NA | CAGGCGAGTCAGGACATTAGCA ACTATTTAAAT SEQ ID NO: 2239 | GATGCATCCAATTTGGAAACA SEQ ID NO: 2396 | CAACAGTATGATATTCTCCTCA CT SEQ ID NO: 2553 |
| | | AA | QASQDISNYLN SEQ ID NO: 669 | DASNLET SEQ ID NO: 826 | QQYDILLT SEQ ID NO: 983 |
| iPS:361043 | 2F11.004 | NA | CAGGCGAGTCAGGACATTAGCA ACTATTTAAAT SEQ ID NO: 2240 | GATGCATCCAATTTGGAAACA SEQ ID NO: 2397 | CAACAGTATGATATTCTCCTCA CT SEQ ID NO: 2554 |
| | | AA | QASQDISNYLN SEQ ID NO: 670 | DASNLET SEQ ID NO: 827 | QQYDILLT SEQ ID NO: 984 |
| iPS:361049 | 2F11.005 | NA | CAGGCGAGTCAGGACATTAGCA ACTATTTAAAT SEQ ID NO: 2241 | GATGCATCCAATTTGGAAACA SEQ ID NO: 2398 | CAACAGTATGATATTCTCCTCA CT SEQ ID NO: 2555 |
| | | AA | QASQDISNYLN SEQ ID NO: 671 | DASNLET SEQ ID NO: 828 | QQYDILLT SEQ ID NO: 985 |
| iPS:361055 | 2F11.006 | NA | CAGGCGAGTCAGGACATTAGCA ACTATTTAAAT SEQ ID NO: 2242 | GATGCATCCAATTTGGAAACA SEQ ID NO: 2399 | CAACAGTATGATATTCTCCTCA CT SEQ ID NO: 2556 |
| | | AA | QASQDISNYLN SEQ ID NO: 672 | DASNLET SEQ ID NO: 829 | QQYDILLT SEQ ID NO: 986 |
| iPS:361059 | 2F11.007 | NA | CAGGCGAGTCAGGACATTAGCA ACTATTTAAAT SEQ ID NO: 2243 | GATGCATCCAATTTGGAAACA SEQ ID NO: 2400 | CAACAGTATGATATTCTCCTCA CT SEQ ID NO: 2557 |
| | | AA | QASQDISNYLN SEQ ID NO: 673 | DASNLET SEQ ID NO: 830 | QQYDILLT SEQ ID NO: 987 |
| iPS:361063 | 2F11.008 | NA | CAGGCGAGTCAGGACATTAGCA ACTATTTAAAT SEQ ID NO: 2244 | GATGCATCCAATTTGGAAACA SEQ ID NO: 2401 | CAACAGTATGATATTCTCCTCA CT SEQ ID NO: 2558 |
| | | AA | QASQDISNYLN SEQ ID NO: 674 | DASNLET SEQ ID NO: 831 | QQYDILLT SEQ ID NO: 988 |
| iPS:359949 | 2F11.009 | NA | CAGGCGAGTCAGGACATTAGCA ACTATTTAAAT SEQ ID NO: 2245 | GATGCATCCAATTTGGAAACA SEQ ID NO: 2402 | CAACAGTATGATATTCTCCTCA CT SEQ ID NO: 2559 |
| | | AA | QASQDISNYLN SEQ ID NO: 675 | DASNLET SEQ ID NO: 832 | QQYDILLT SEQ ID NO: 989 |
| iPS:359956 | 2F11.010 | NA | CAGGCGAGTCAGGACATTAGCA ACTATTTAAAT SEQ ID NO: 2246 | GATGCATCCAATTTGGAAACA SEQ ID NO: 2403 | CAACAGTATGATATTCTCCTCA CT SEQ ID NO: 2560 |
| | | AA | QASQDISNYLN SEQ ID NO: 676 | DASNLET SEQ ID NO: 833 | QQYDILLT SEQ ID NO: 990 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:359865 | 6H1.002 | NA | CGGGCAAGTCAGGACATTAGAG ATTATTTAGGC SEQ ID NO: 2247 | GGTGCATCCAGTTTGCAAAGT SEQ ID NO: 2404 | CTACAGCATAATAATTACCCCT TCACT SEQ ID NO: 2561 |
| | | AA | RASQDIRDYLG SEQ ID NO: 677 | GASSLQS SEQ ID NO: 834 | LQHNNYPFT SEQ ID NO: 991 |
| iPS:359869 | 6H1.003 | NA | CGGGCAAGTCAGGACATTAGAG ATTATTTAGGC SEQ ID NO: 2248 | GGTGCATCCAGTTTGCAAAGT SEQ ID NO: 2405 | CTACAGCATAATAATTACCCCT TCACT SEQ ID NO: 2562 |
| | | AA | RASQDIRDYLG SEQ ID NO: 678 | GASSLQS SEQ ID NO: 835 | LQHNNYPFT SEQ ID NO: 992 |
| iPS:359873 | 6H1.004 | NA | CGGGCAAGTCAGGACATTAGAG ATTATTTAGGC SEQ ID NO: 2249 | GGTGCATCCAGTTTGCAAAGT SEQ ID NO: 2406 | CTACAGCATAATAATTACCCCT TCACT SEQ ID NO: 2563 |
| | | AA | RASQDIRDYLG SEQ ID NO: 679 | GASSLQS SEQ ID NO: 836 | LQHNNYPFT SEQ ID NO: 993 |
| iPS:359877 | 6H1.005 | NA | CGGGCAAGTCAGGACATTAGAG ATTATTTAGGC SEQ ID NO: 2250 | GGTGCATCCAGTTTGCAAAGT SEQ ID NO: 2407 | CTACAGCATAATAATTACCCCT TCACT SEQ ID NO: 2564 |
| | | AA | RASQDIRDYLG SEQ ID NO: 680 | GASSLQS SEQ ID NO: 837 | LQHNNYPFT SEQ ID NO: 994 |
| iPS:361067 | 6H1.006 | NA | CGGGCAAGTCAGGACATTAGAG ATTATTTAGGC SEQ ID NO: 2251 | GGTGCATCCAGTTTGCAAAGT SEQ ID NO: 2408 | CTACAGCATAATAATTACCCCT TCACT SEQ ID NO: 2565 |
| | | AA | RASQDIRDYLG SEQ ID NO: 681 | GASSLQS SEQ ID NO: 838 | LQHNNYPFT SEQ ID NO: 995 |
| iPS:361071 | 6H1.007 | NA | CGGGCAAGTCAGGACATTAGAG ATTATTTAGGC SEQ ID NO: 2252 | GGTGCATCCAGTTTGCAAAGT SEQ ID NO: 2409 | CTACAGCATAATAATTACCCCT TCACT SEQ ID NO: 2566 |
| | | AA | RASQDIRDYLG SEQ ID NO: 682 | GASSLQS SEQ ID NO: 839 | LQHNNYPFT SEQ ID NO: 996 |
| iPS:361075 | 6H1.008 | NA | CGGGCAAGTCAGGACATTAGAG ATTATTTAGGC SEQ ID NO: 2253 | GGTGCATCCAGTTTGCAAAGT SEQ ID NO: 2410 | CTACAGCATAATAATTACCCCT TCACT SEQ ID NO: 2567 |
| | | AA | RASQDIRDYLG SEQ ID NO: 683 | GASSLQS SEQ ID NO: 840 | LQHNNYPFT SEQ ID NO: 997 |
| iPS:361079 | 6A5.004.001 | NA | CAGGCGAGTCAGGACATTACCA ACTATTTAAAT SEQ ID NO: 2254 | GATGCTTCCAATTTGGAGCCA SEQ ID NO: 2411 | CAACAGTATGATGATCTATTCA CT SEQ ID NO: 2568 |
| | | AA | QASQDITNYLN SEQ ID NO: 684 | DASNLEP SEQ ID NO: 841 | QQYDDLFT SEQ ID NO: 998 |
| iPS:361085 | 6A5.004.002 | NA | CAGGCGAGTCAGGACATTACCA ACTATTTAAAT SEQ ID NO: 2255 | GATGCTTCCAATTTGGAGCCA SEQ ID NO: 2412 | CAACAGTATGATGATCTATTCA CT SEQ ID NO: 2569 |
| | | AA | QASQDITNYLN SEQ ID NO: 685 | DASNLEP SEQ ID NO: 842 | QQYDDLFT SEQ ID NO: 999 |
| iPS:361091 | 6A5.004.003 | NA | CAGGCGAGTCAGGACATTACCA ACTATTTAAAT SEQ ID NO: 2256 | GATGCTTCCAATTTGGAGCCA SEQ ID NO: 2413 | CAACAGTATGATGATCTATTCA CT SEQ ID NO: 2570 |
| | | AA | QASQDITNYLN SEQ ID NO: 686 | DASNLEP SEQ ID NO: 843 | QQYDDLFT SEQ ID NO: 1000 |
| iPS:361095 | 6A5.004.004 | NA | CAGGCGAGTCAGGACATTACCA ACTATTTAAAT SEQ ID NO: 2257 | GATGCTTCCAATTTGGAGCCA SEQ ID NO: 2414 | CAACAGTATGATGATCTATTCA CT SEQ ID NO: 2571 |
| | | AA | QASQDITNYLN SEQ ID NO: 687 | DASNLEP SEQ ID NO: 844 | QQYDDLFT SEQ ID NO: 1001 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:361101 | 6A5.004.005 | NA | CAGGCGAGTCAGGACATTACCA ACTATTTAAAT SEQ ID NO: 2258 | GATGCTTCCAATTTGGAGCCA SEQ ID NO: 2415 | CAACAGTATGATGATCTATTCA CT SEQ ID NO: 2572 |
| | | AA | QASQDITNYLN SEQ ID NO: 688 | DASNLEP SEQ ID NO: 845 | QQYDDLFT SEQ ID NO: 1002 |
| iPS:361105 | 6A5.004.006 | NA | CAGGCGAGTCAGGACATTACCA ACTATTTAAAT SEQ ID NO: 2259 | GATGCTTCCAATTTGGAGCCA SEQ ID NO: 2416 | CAACAGTATGATGATCTATTCA CT SEQ ID NO: 2573 |
| | | AA | QASQDITNYLN SEQ ID NO: 689 | DASNLEP SEQ ID NO: 846 | QQYDDLFT SEQ ID NO: 1003 |
| iPS:361109 | 6A5.004.007 | NA | CAGGCGAGTCAGGACATTACCA ACTATTTAAAT SEQ ID NO: 2260 | GATGCTTCCAATTTGGAGCCA SEQ ID NO: 2417 | CAACAGTATGATGATCTATTCA CT SEQ ID NO: 2574 |
| | | AA | QASQDITNYLN SEQ ID NO: 690 | DASNLEP SEQ ID NO: 847 | QQYDDLFT SEQ ID NO: 1004 |
| iPS:361113 | 6A5.004.008 | NA | CAGGCGAGTCAGGACATTACCA ACTATTTAAAT SEQ ID NO: 2261 | GATGCTTCCAATTTGGAGCCA SEQ ID NO: 2418 | CAACAGTATGATGATCTATTCA CT SEQ ID NO: 2575 |
| | | AA | QASQDITNYLN SEQ ID NO: 691 | DASNLEP SEQ ID NO: 848 | QQYDDLFT SEQ ID NO: 1005 |
| iPS:361120 | 6A5.004.009 | NA | CAGGCGAGTCAGGACATTACCA ACTATTTAAAT SEQ ID NO: 2262 | GATGCTTCCAATTTGGAGCCA SEQ ID NO: 2419 | CAACAGTATGATGATCTATTCA CT SEQ ID NO: 2576 |
| | | AA | QASQDITNYLN SEQ ID NO: 692 | DASNLEP SEQ ID NO: 849 | QQYDDLFT SEQ ID NO: 1006 |
| iPS:359896 | 6A5.004.010 | NA | CAGGCGAGTCAGGACATTACCA ACTATTTAAAT SEQ ID NO: 2263 | GATGCTTCCAATTTGGAGCCA SEQ ID NO: 2420 | CAACAGTATGATGATCTATTCA CT SEQ ID NO: 2577 |
| | | AA | QASQDITNYLN SEQ ID NO: 693 | DASNLEP SEQ ID NO: 850 | QQYDDLFT SEQ ID NO: 1007 |
| iPS:359890 | 6A5.004.011 | NA | CAGGCGAGTCAGGACATTACCA ACTATTTAAAT SEQ ID NO: 2264 | GATGCTTCCAATTTGGAGCCA SEQ ID NO: 2421 | CAACAGTATGATGATCTATTCA CT SEQ ID NO: 2578 |
| | | AA | QASQDITNYLN SEQ ID NO: 694 | DASNLEP SEQ ID NO: 851 | QQYDDLFT SEQ ID NO: 1008 |
| iPS:359567 | 2A11.002 | NA | AGGGCCAGTCAGATTTTTACCA GCACCTACTTAGCC SEQ ID NO: 2265 | GGTGCATCCAGCAGGGCCACT SEQ ID NO: 2422 | CAGCAGTATGGTAGCTCACCTC GC SEQ ID NO: 2579 |
| | | AA | RASQIFTSTYLA SEQ ID NO: 695 | GASSRAT SEQ ID NO: 852 | QQYGSSPR SEQ ID NO: 1009 |
| iPS:335965 | 2A11.003 | NA | AGGGCCAGTCAGATTTTTACCA GCACCTACTTAGCC SEQ ID NO: 2266 | GGTGCATCCAGCAGGGCCACT SEQ ID NO: 2423 | CAGCAGTATGGTAGCTCACCTC GC SEQ ID NO: 2580 |
| | | AA | RASQIFTSTYLA SEQ ID NO: 696 | GASSRAT SEQ ID NO: 853 | QQYGSSPR SEQ ID NO: 1010 |
| iPS:361158 | 2A11.004 | NA | AGGGCCAGTCAGATTTTTACCA GCACCTACTTAGCC SEQ ID NO: 2267 | GGTGCATCCAGCAGGGCCACT SEQ ID NO: 2424 | CAGCAGTATGGTAGCTCACCTC GC SEQ ID NO: 2581 |
| | | AA | RASQIFTSTYLA SEQ ID NO: 697 | GASSRAT SEQ ID NO: 854 | QQYGSSPR SEQ ID NO: 1011 |
| iPS:361165 | 2A11.005 | NA | AGGGCCAGTCAGATTTTTACCA GCACCTACTTAGCC SEQ ID NO: 2268 | GGTGCATCCAGCAGGGCCACT SEQ ID NO: 2425 | CAGCAGTATGGTAGCTCACCTC GC SEQ ID NO: 2582 |
| | | AA | RASQIFTSTYLA SEQ ID NO: 698 | GASSRAT SEQ ID NO: 855 | QQYGSSPR SEQ ID NO: 1012 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:361172 | 2G10_LC1.003NA | | AGGGCCAGTCAGAGTGTTAGCA GCAACTTAGCC SEQ ID NO: 2269 | GGTGCAGCCACCAGGGCCACT SEQ ID NO: 2426 | CAGCAGTATAATAACTGGCCTC TCACT SEQ ID NO: 2583 |
| | | AA | RASQSVSSNLA SEQ ID NO: 699 | GAATRAT SEQ ID NO: 856 | QQYNNWPLT SEQ ID NO: 1013 |
| iPS:361178 | 2G10_LC1.004 | NA | AGGGCCAGTCAGAGTGTTAGCA GCAACTTAGCC SEQ ID NO: 2270 | GGTGCAGCCACCAGGGCCACT SEQ ID NO: 2427 | CAGCAGTATAATAACTGGCCTC TCACT SEQ ID NO: 2584 |
| | | AA | RASQSVSSNLA SEQ ID NO: 700 | GAATRAT SEQ ID NO: 857 | QQYNNWPLT SEQ ID NO: 1014 |
| iPS:361185 | 2G10_LC1.005 | NA | AGGGCCAGTCAGAGTGTTAGCA GCAACTTAGCC SEQ ID NO: 2271 | GGTGCAGCCACCAGGGCCACT SEQ ID NO: 2428 | CAGCAGTATAATAACTGGCCTC TCACT SEQ ID NO: 2585 |
| | | AA | RASQSVSSNLA SEQ ID NO: 701 | GAATRAT SEQ ID NO: 858 | QQYNNWPLT SEQ ID NO: 1015 |
| iPS:361192 | 2G10_LC1.006 | NA | AGGGCCAGTCAGAGTGTTAGCA GCAACTTAGCC SEQ ID NO: 2272 | GGTGCAGCCACCAGGGCCACT SEQ ID NO: 2429 | CAGCAGTATAATAACTGGCCTC TCACT SEQ ID NO: 2586 |
| | | AA | RASQSVSSNLA SEQ ID NO: 702 | GAATRAT SEQ ID NO: 859 | QQYNNWPLT SEQ ID NO: 1016 |
| iPS:359609 | 2G10_LC1.007 | NA | AGGGCCAGTCAGAGTGTTAGCA GCAACTTAGCC SEQ ID NO: 2273 | GGTGCAGCCACCAGGGCCACT SEQ ID NO: 2430 | CAGCAGTATAATAACTTCCCTC TCACT SEQ ID NO: 2587 |
| | | AA | RASQSVSSNLA SEQ ID NO: 703 | GAATRAT SEQ ID NO: 860 | QQYNNFPLT SEQ ID NO: 1017 |
| iPS:359615 | 2G10_LC1.008 | NA | AGGGCCAGTCAGAGTGTTAGCA GCAACTTAGCC SEQ ID NO: 2274 | GGTGCAGCCACCAGGGCCACT SEQ ID NO: 2431 | CAGCAGTATAATAACTATCCTC TCACT SEQ ID NO: 2588 |
| | | AA | RASQSVSSNLA SEQ ID NO: 704 | GAATRAT SEQ ID NO: 861 | QQYNNYPLT SEQ ID NO: 1018 |
| iPS:361196 | 2G10_LC1.009 | NA | AGGGCCAGTCAGAGTGTTAGCA GCAACTTAGCC SEQ ID NO: 2275 | GGTGCAGCCACCAGGGCCACT SEQ ID NO: 2432 | CAGCAGTATAATAACTGGCCTC TCACT SEQ ID NO: 2589 |
| | | AA | RASQSVSSNLA SEQ ID NO: 705 | GAATRAT SEQ ID NO: 862 | QQYNNWPLT SEQ ID NO: 1019 |
| iPS:361202 | 2G10_LC1.010 | NA | AGGGCCAGTCAGAGTGTTAGCA GCAACTTAGCC SEQ ID NO: 2276 | GGTGCAGCCACCAGGGCCACT SEQ ID NO: 2433 | CAGCAGTATAATAACTGGCCTC TCACT SEQ ID NO: 2590 |
| | | AA | RASQSVSSNLA SEQ ID NO: 706 | GAATRAT SEQ ID NO: 863 | QQYNNWPLT SEQ ID NO: 1020 |
| iPS:359644 | 18E3.002 | NA | AGGGCCAGTCAGAGTATTAGTT ACAGTTACTTAGCC SEQ ID NO: 2277 | GGTGCATCCAGCAGGGCCACT SEQ ID NO: 2434 | CAGCAGTATGGTAGTTCACCGC TCACT SEQ ID NO: 2591 |
| | | AA | RASQSISYSYLA SEQ ID NO: 707 | GASSRAT SEQ ID NO: 864 | QQYGSSPLT SEQ ID NO: 1021 |
| iPS:361206 | 18E3.003 | NA | AGGGCCAGTCAGAGTATTAGTT ACAGTTACTTAGCC SEQ ID NO: 2278 | GGTGCATCCAGCAGGGCCACT SEQ ID NO: 2435 | CAGCAGTATGGTAGTTCACCGC TCACT SEQ ID NO: 2592 |
| | | AA | RASQSISYSYLA SEQ ID NO: 708 | GASSRAT SEQ ID NO: 865 | QQYGSSPLT SEQ ID NO: 1022 |
| iPS:359628 | 18E3.004 | NA | AGGGCCAGTCAGAGTATTAGTT ACAGTTACTTAGCC SEQ ID NO: 2279 | GGTGCATCCAGCAGGGCCACT SEQ ID NO: 2436 | CAGCAGTATGGTAGTTCACCGC TCACT SEQ ID NO: 2593 |
| | | AA | RASQSISYSYLA SEQ ID NO: 709 | GASSRAT SEQ ID NO: 866 | QQYGSSPLT SEQ ID NO: 1023 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:359637 | 18E3.005 | NA | AGGGCCAGTCAGAGTATTAGTT ACAGTTACTTAGCC SEQ ID NO: 2280 | GGTGCATCCAGCAGGGCCACT SEQ ID NO: 2437 | CAGCAGTATGGTAGTTCACCGC TCACT SEQ ID NO: 2594 |
| | | AA | RASQSISYSYLA SEQ ID NO: 710 | GASSRAT SEQ ID NO: 867 | QQYGSSPLT SEQ ID NO: 1024 |
| iPS:361210 | 18E3.006 | NA | AGGGCCAGTCAGAGTATTAGTT ACAGTTACTTAGCC SEQ ID NO: 2281 | GGTGCATCCAGCAGGGCCACT SEQ ID NO: 2438 | CAGCAGTATGGTAGTTCACCGC TCACT SEQ ID NO: 2595 |
| | | AA | RASQSISYSYLA SEQ ID NO: 711 | GASSRAT SEQ ID NO: 868 | QQYGSSPLT SEQ ID NO: 1025 |
| iPS:361214 | 18E3.007 | NA | AGGGCCAGTCAGAGTATTAGTT ACAGTTACTTAGCC SEQ ID NO: 2282 | GGTGCATCCAGCAGGGCCACT SEQ ID NO: 2439 | CAGCAGTATGGTAGTTCACCGC TCACT SEQ ID NO: 2596 |
| | | AA | RASQSISYSYLA SEQ ID NO: 712 | GASSRAT SEQ ID NO: 869 | QQYGSSPLT SEQ ID NO: 1026 |
| iPS:361218 | 18E3.007 | NA | AGGGCCAGTCAGAGTATTAGTT ACAGTTACTTAGCC SEQ ID NO: 2283 | GGTGCATCCAGCAGGGCCACT SEQ ID NO: 2440 | CAGCAGTATGGTAGTTCACCGC TCACT SEQ ID NO: 2597 |
| | | AA | RASQSISYSYLA SEQ ID NO: 713 | GASSRAT SEQ ID NO: 870 | QQYGSSPLT SEQ ID NO: 1027 |
| iPS:361222 | 5C2.006 | NA | AAGTCCAGCCAGAGTGTTTTAT CCAGCTCCAACAATAAGAACTA CATAGCT SEQ ID NO: 2284 | TGGGCATCTACCCGGGAATCC SEQ ID NO: 2441 | CAACAATATTATAGTACTCCGT GGACG SEQ ID NO: 2598 |
| | | AA | KSSQSVLSSSNNKNYIA SEQ ID NO: 714 | WASTRES SEQ ID NO: 871 | QQYYSTPWT SEQ ID NO: 1028 |
| iPS:361229 | 5C2.007 | NA | AAGTCCAGCCAGAGTGTTTTAT CCAGCTCCAACAATAAGAACTA CATAGCT SEQ ID NO: 2285 | TGGGCATCTACCCGGGAATCC SEQ ID NO: 2442 | CAACAATATTATAGTACTCCGT GGACG SEQ ID NO: 2599 |
| | | AA | KSSQSVLSSSNNKNYIA SEQ ID NO: 715 | WASTRES SEQ ID NO: 872 | QQYYSTPWT SEQ ID NO: 1029 |
| iPS:361236 | 5C2.008 | NA | AAGTCCAGCCAGAGTGTTTTAT CCAGCTCCAACAATAAGAACTA CATAGCT SEQ ID NO: 2286 | TGGGCATCTACCCGGGAATCC SEQ ID NO: 2443 | CAACAATATTATAGTACTCCGT GGACG SEQ ID NO: 2600 |
| | | AA | KSSQSVLSSSNNKNYIA SEQ ID NO: 716 | WASTRES SEQ ID NO: 873 | QQYYSTPWT SEQ ID NO: 1030 |
| iPS:359685 | 5C2.009 | NA | AAGTCCAGCCAGAGTGTTTTAT CCAGCTCCAACAATAAGAACTA CATAGCT SEQ ID NO: 2287 | TGGGCATCTACCCGGGAATCC SEQ ID NO: 2444 | CAACAATATTATAGTACTCCGT GGACG SEQ ID NO: 2601 |
| | | AA | KSSQSVLSSSNNKNYIA SEQ ID NO: 717 | WASTRES SEQ ID NO: 874 | QQYYSTPWT SEQ ID NO: 1031 |
| iPS:361240 | 5C2.010 | NA | AAGTCCAGCCAGAGTGTTTTAT CCAGCTCCAACAATAAGAACTA CATAGCT SEQ ID NO: 2288 | TGGGCATCTACCCGGGAATCC SEQ ID NO: 2445 | CAACAATATTATAGTACTCCGT GGACG SEQ ID NO: 2602 |
| | | AA | KSSQSVLSSSNNKNYIA SEQ ID NO: 718 | WASTRES SEQ ID NO: 875 | QQYYSTPWT SEQ ID NO: 1032 |
| iPS:361247 | 5C2.011 | NA | AAGTCCAGCCAGAGTGTTTTAT CCAGCTCCAACAATAAGAACTA CATAGCT SEQ ID NO: 2289 | TGGGCATCTACCCGGGAATCC SEQ ID NO: 2446 | CAACAATATTATAGTACTCCGT GGACG SEQ ID NO: 2603 |
| | | AA | KSSQSVLSSSNNKNYIA SEQ ID NO: 719 | WASTRES SEQ ID NO: 876 | QQYYSTPWT SEQ ID NO: 1033 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:361254 | 5C2.012 | NA | AAGTCCAGCCAGAGTGTTTTAT CCAGCTCCAACAATAAGAACTA CATAGCT SEQ ID NO: 2290 | TGGGCATCTACCCGGGAATCC SEQ ID NO: 2447 | CAACAATATTATAGTACTCCGT GGACG SEQ ID NO: 2604 |
| | | AA | KSSQSVLSSSNNKNYIA SEQ ID NO: 720 | WASTRES SEQ ID NO: 877 | QQYYSTPWT SEQ ID NO: 1034 |
| iPS:361261 | 5C2.013 | NA | AAGTCCAGCCAGAGTGTTTTAT CCAGCTCCAACAATAAGAACTA CATAGCT SEQ ID NO: 2291 | TGGGCATCTACCCGGGAATCC SEQ ID NO: 2448 | CAACAATATTATAGTACTCCGT GGACG SEQ ID NO: 2605 |
| | | AA | KSSQSVLSSSNNKNYIA SEQ ID NO: 721 | WASTRES SEQ ID NO: 878 | QQYYSTPWT SEQ ID NO: 1035 |
| iPS:361268 | 5C2.014 | NA | AAGTCCAGCCAGAGTGTTTTAT CCAGCTCCAACAATAAGAACTA CATAGCT SEQ ID NO: 2292 | TGGGCATCTACCCGGGAATCC SEQ ID NO: 2449 | CAACAATATTATAGTACTCCGT GGACG SEQ ID NO: 2606 |
| | | AA | KSSQSVLSSSNNKNYIA SEQ ID NO: 722 | WASTRES SEQ ID NO: 879 | QQYYSTPWT SEQ ID NO: 1036 |
| iPS:359669 | 5C2.015 | NA | AAGTCCAGCCAGAGTGTTTTAT CCAGCTCCAACAATAAGAACTA CATAGCT SEQ ID NO: 2293 | TGGGCATCTACCCGGGAATCC SEQ ID NO: 2450 | CAACAATATTATAGTACTCCGT GGACG SEQ ID NO: 2607 |
| | | AA | KSSQSVLSSSNNKNYIA SEQ ID NO: 723 | WASTRES SEQ ID NO: 880 | QQYYSTPWT SEQ ID NO: 1037 |
| iPS:359678 | 5C2.016 | NA | AAGTCCAGCCAGAGTGTTTTAT CCAGCTCCAACAATAAGAACTA CATAGCT SEQ ID NO: 2294 | TGGGCATCTACCCGGGAATCC SEQ ID NO: 2451 | CAACAATATTATAGTACTCCGT GGACG SEQ ID NO: 2608 |
| | | AA | KSSQSVLSSSNNKNYIA SEQ ID NO: 724 | WASTRES SEQ ID NO: 881 | QQYYSTPWT SEQ ID NO: 1038 |
| iPS:361275 | 11C1.002 | NA | AAGTCCAGCCAGAGTGTTTTAT CCAGCTCCAACAATAAGAACTA CTTAGCT SEQ ID NO: 2295 | TGGACTTCTACCCGAGAATCC SEQ ID NO: 2452 | CAGCAATATTATCGTACTCCGT GGACG SEQ ID NO: 2609 |
| | | AA | KSSQSVLSSSNNKNYLA SEQ ID NO: 725 | WTSTRES SEQ ID NO: 882 | QQYYRTPWT SEQ ID NO: 1039 |
| iPS:361282 | 11C1.003 | NA | AAGTCCAGCCAGAGTGTTTTAT CCAGCTCCAACAATAAGAACTA CTTAGCT SEQ ID NO: 2296 | TGGACTTCTACCCGAGAATCC SEQ ID NO: 2453 | CAGCAATATTATCGTACTCCGT GGACG SEQ ID NO: 2610 |
| | | AA | KSSQSVLSSSNNKNYLA SEQ ID NO: 726 | WTSTRES SEQ ID NO: 883 | QQYYRTPWT SEQ ID NO: 1040 |
| iPS:361289 | 11C1.004 | NA | AAGTCCAGCCAGAGTGTTTTAT CCAGCTCCAACAATAAGAACTA CTTAGCT SEQ ID NO: 2297 | TGGACTTCTACCCGAGATTCC SEQ ID NO: 2454 | CAGCAATATTATCGTACTCCGT GGACG SEQ ID NO: 2611 |
| | | AA | KSSQSVLSSSNNKNYLA SEQ ID NO: 727 | WTSTRDS SEQ ID NO: 884 | QQYYRTPWT SEQ ID NO: 1041 |
| iPS:359712 | 11C1.005 | NA | AAGTCCAGCCAGAGTGTTTTAT CCAGCTCCAACAATAAGAACTA CTTAGCT SEQ ID NO: 2298 | TGGACTTCTACCCGAGAATCC SEQ ID NO: 2455 | CAGCAATATTATCGTACTCCGT GGACG SEQ ID NO: 2612 |
| | | AA | KSSQSVLSSSNNKNYLA SEQ ID NO: 728 | WTSTRES SEQ ID NO: 885 | QQYYRTPWT SEQ ID NO: 1042 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:361293 | 11C1.006 | NA | AAGTCCAGCCAGAGTGTTTTAT CCAGCTCCAACAATAAGAACTA CTTAGCT SEQ ID NO: 2299 | TGGACTTCTACCCGAGAATCC SEQ ID NO: 2456 | CAGCAATATTATCGTACTCCGT GGACG SEQ ID NO: 2613 |
| | | AA | KSSQSVLSSSNNKNYLA SEQ ID NO: 729 | WTSTRES SEQ ID NO: 886 | QQYYRTPWT SEQ ID NO: 1043 |
| iPS:361297 | 11C1.007 | NA | AAGTCCAGCCAGAGTGTTTTAT CCAGCTCCAACAATAAGAACTA CTTAGCT SEQ ID NO: 2300 | TGGACTTCTACCCGAGATTCC SEQ ID NO: 2457 | CAGCAATATTATCGTACTCCGT GGACG SEQ ID NO: 2614 |
| | | AA | KSSQSVLSSSNNKNYLA SEQ ID NO: 730 | WTSTRDS SEQ ID NO: 887 | QQYYRTPWT SEQ ID NO: 1044 |
| iPS:361301 | 11C1.008 | NA | AAGTCCAGCCAGAGTGTTTTAT CCAGCTCCAACAATAAGAACTA CTTAGCT SEQ ID NO: 2301 | TGGACTTCTACCCGAGATTCC SEQ ID NO: 2458 | CAGCAATATTATCGTACTCCGT GGACG SEQ ID NO: 2615 |
| | | AA | KSSQSVLSSSNNKNYLA SEQ ID NO: 731 | WTSTRDS SEQ ID NO: 888 | QQYYRTPWT SEQ ID NO: 1045 |
| iPS:359703 | 11C1.009 | NA | AAGTCCAGCCAGAGTGTTTTAT CCAGCTCCAACAATAAGAACTA CTTAGCT SEQ ID NO: 2302 | TGGACTTCTACCCGAGAATCC SEQ ID NO: 2459 | CAGCAATATTATCGTACTCCGT GGACG SEQ ID NO: 2616 |
| | | AA | KSSQSVLSSSNNKNYLA SEQ ID NO: 732 | WTSTRES SEQ ID NO: 889 | QQYYRTPWT SEQ ID NO: 1046 |
| iPS:361305 | 11C1.010 | NA | AAGTCCAGCCAGAGTGTTTTAT CCAGCTCCAACAATAAGAACTA CTTAGCT SEQ ID NO: 2303 | TGGACTTCTACCCGAGAATCC SEQ ID NO: 2460 | CAGCAATATTATCGTACTCCGT GGACG SEQ ID NO: 2617 |
| | | AA | KSSQSVLSSSNNKNYLA SEQ ID NO: 733 | WTSTRES SEQ ID NO: 890 | QQYYRTPWT SEQ ID NO: 1047 |
| iPS:361312 | 13H12.002 | NA | AAGTCCAGCCAGAGTGTTTTAT CCAGCTCCAACAATAAGAACTA CATAGCT SEQ ID NO: 2304 | TGGGCATCTACCCGGGAATCC SEQ ID NO: 2461 | CAACAATATTATAGTACTCCGT GGACG SEQ ID NO: 2618 |
| | | AA | KSSQSVLSSSNNKNYIA SEQ ID NO: 734 | WASTRES SEQ ID NO: 891 | QQYYSTPWT SEQ ID NO: 1048 |
| iPS:359744 | 13H12.003 | NA | AAGTCCAGCCAGAGTGTTTTAT CCAGCTCCAACAATAAGAACTA CATAGCT SEQ ID NO: 2305 | TGGGCATCTACCCGGGAATCC SEQ ID NO: 2462 | CAACAATATTATAGTACTCCGT GGACG SEQ ID NO: 2619 |
| | | AA | KSSQSVLSSSNNKNYIA SEQ ID NO: 735 | WASTRES SEQ ID NO: 892 | QQYYSTPWT SEQ ID NO: 1049 |
| iPS:361319 | 13H12.004 | NA | AAGTCCAGCCAGAGTGTTTTAT CCAGCTCCAACAATAAGAACTA CATAGCT SEQ ID NO: 2306 | TGGGCATCTACCCGGGAATCC SEQ ID NO: 2463 | CAACAATATTATAGTACTCCGT GGACG SEQ ID NO: 2620 |
| | | AA | KSSQSVLSSSNNKNYIA SEQ ID NO: 736 | WASTRES SEQ ID NO: 893 | QQYYSTPWT SEQ ID NO: 1050 |
| iPS:359737 | 13H12.005 | NA | AAGTCCAGCCAGAGTGTTTTAT CCAGCTCCAACAATAAGAACTA CATAGCT SEQ ID NO: 2307 | TGGGCATCTACCCGGGAATCC SEQ ID NO: 2464 | CAACAATATTATAGTACTCCGT GGACG SEQ ID NO: 2621 |
| | | AA | KSSQSVLSSSNNKNYIA SEQ ID NO: 737 | WASTRES SEQ ID NO: 894 | QQYYSTPWT SEQ ID NO: 1051 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:361326 | 13H12.006 | NA | AAGTCCAGCCAGAGTGTTTTAT CCAGCTCCAACAATAAGAACTA CATAGCT SEQ ID NO: 2308 | TGGGCATCTACCCGGGAATCC SEQ ID NO: 2465 | CAACAATATTATAGTACTCCGT GGACG SEQ ID NO: 2622 |
| | | AA | KSSQSVLSSSNNKNYIA SEQ ID NO: 738 | WASTRES SEQ ID NO: 895 | QQYYSTPWT SEQ ID NO: 1052 |
| iPS:361330 | 12H11.002 | NA | AAGTCCAGCCAGAGTGTTTTAT CCAGCTCCAACAATAAGAACTA CTTAGCT SEQ ID NO: 2309 | TGGACTTCTACCCGAGATTCC SEQ ID NO: 2466 | CAGCAATATTATCGTACTCCGT GGACG SEQ ID NO: 2623 |
| | | AA | KSSQSVLSSSNNKNYLA SEQ ID NO: 739 | WTSTRDS SEQ ID NO: 896 | QQYYRTPWT SEQ ID NO: 1053 |
| iPS:361337 | 12H11.002 | NA | AAGTCCAGCCAGAGTGTTTTAT CCAGCTCCAACAATAAGAACTA CTTAGCT SEQ ID NO: 2310 | TGGACTTCTACCCGAGATTCC SEQ ID NO: 2467 | CAGCAATATTATCGTACTCCGT GGACG SEQ ID NO: 2624 |
| | | AA | KSSQSVLSSSNNKNYLA SEQ ID NO: 740 | WTSTRDS SEQ ID NO: 897 | QQYYRTPWT SEQ ID NO: 1054 |
| iPS:361344 | 12H11.004 | NA | AAGTCCAGCCAGAGTGTTTTAT CCAGCTCCAACAATAAGAACTA CTTAGCT SEQ ID NO: 2311 | TGGACTTCTACCCGAGATTCC SEQ ID NO: 2468 | CAGCAATATTATCGTACTCCGT GGACG SEQ ID NO: 2625 |
| | | AA | KSSQSVLSSSNNKNYLA SEQ ID NO: 741 | WTSTRDS SEQ ID NO: 898 | QQYYRTPWT SEQ ID NO: 1055 |
| iPS:361351 | 12H11.005 | NA | AAGTCCAGCCAGAGTGTTTTAT CCAGCTCCAACAATAAGAACTA CTTAGCT SEQ ID NO: 2312 | TGGACTTCTACCCGAGATTCC SEQ ID NO: 2469 | CAGCAATATTATCGTACTCCGT GGACG SEQ ID NO: 2626 |
| | | AA | KSSQSVLSSSNNKNYLA SEQ ID NO: 742 | WTSTRDS SEQ ID NO: 899 | QQYYRTPWT SEQ ID NO: 1056 |
| iPS:361358 | 12H11.006 | NA | AAGTCCAGCCAGAGTGTTTTAT CCAGCTCCAACAATAAGAACTA CTTAGCT SEQ ID NO: 2313 | TGGACTTCTACCCGAGATTCC SEQ ID NO: 2470 | CAGCAATATTATCGTACTCCGT GGACG SEQ ID NO: 2627 |
| | | AA | KSSQSVLSSSNNKNYLA SEQ ID NO: 743 | WTSTRDS SEQ ID NO: 900 | QQYYRTPWT SEQ ID NO: 1057 |
| iPS:361365 | 12H11.007 | NA | AAGTCCAGCCAGAGTGTTTTAT CCAGCTCCAACAATAAGAACTA CTTAGCT SEQ ID NO: 2314 | TGGACTTCTACCCGAGATTCC SEQ ID NO: 2471 | CAGCAATATTATCGTACTCCGT GGACG SEQ ID NO: 2628 |
| | | AA | KSSQSVLSSSNNKNYLA SEQ ID NO: 744 | WTSTRDS SEQ ID NO: 901 | QQYYRTPWT SEQ ID NO: 1058 |
| iPS:361372 | 12H11.008 | NA | AAGTCCAGCCAGAGTGTTTTAT CCAGCTCCAACAATAAGAACTA CTTAGCT SEQ ID NO: 2315 | TGGACTTCTACCCGAGATTCC SEQ ID NO: 2472 | CAGCAATATTATCGTACTCCGT GGACG SEQ ID NO: 2629 |
| | | AA | KSSQSVLSSSNNKNYLA SEQ ID NO: 745 | WTSTRDS SEQ ID NO: 902 | QQYYRTPWT SEQ ID NO: 1059 |
| iPS:361379 | 12H11.009 | NA | AAGTCCAGCCAGAGTGTTTTAT CCAGCTCCAACAATAAGAACTA CTTAGCT SEQ ID NO: 2316 | TGGACTTCTACCCGAGAATCC SEQ ID NO: 2473 | CAGCAATATTATCGTACTCCGT GGACG SEQ ID NO: 2630 |
| | | AA | KSSQSVLSSSNNKNYLA SEQ ID NO: 746 | WTSTRES SEQ ID NO: 903 | QQYYRTPWT SEQ ID NO: 1060 |

TABLE 4A-continued

Exemplary CDRL1, CDRL2, and CDRL3 Nucleic Acid ("NA") and Amino Acid ("AA") Sequences

| iPS# | Ab | Type | CDRL1 | CDRL2 | CDRL3 |
|---|---|---|---|---|---|
| iPS:361383 | 12H11.010 | NA | AAGTCCAGCCAGAGTGTTTTAT CCAGCTCCAACAATAAGAACTA CTTAGCT SEQ ID NO: 2317 | TGGACTTCTACCCGAGAATCC SEQ ID NO: 2474 | CAGCAATATTATCGTACTCCGT GGACG SEQ ID NO: 2631 |
| | | AA | KSSQSVLSSSNNKNYLA SEQ ID NO: 747 | WTSTRES SEQ ID NO: 904 | QQYYRTPWT SEQ ID NO: 1061 |
| iPS:361387 | 12H11.011 | NA | AAGTCCAGCCAGAGTGTTTTAT CCAGCTCCAACAATAAGAACTA CTTAGCT SEQ ID NO: 2318 | TGGACTTCTACCCGAGAATCC SEQ ID NO: 2475 | CAGCAATATTATCGTACTCCGT GGACG SEQ ID NO: 2632 |
| | | AA | KSSQSVLSSSNNKNYLA SEQ ID NO: 748 | WTSTRES SEQ ID NO: 905 | QQYYRTPWT SEQ ID NO: 1062 |
| iPS:361391 | 12H11.012 | NA | AAGTCCAGCCAGAGTGTTTTAT CCAGCTCCAACAATAAGAACTA CTTAGCT SEQ ID NO: 2319 | TGGACTTCTACCCGAGAATCC SEQ ID NO: 2476 | CAGCAATATTATCGTACTCCGT GGACG SEQ ID NO: 2633 |
| | | AA | KSSQSVLSSSNNKNYLA SEQ ID NO: 749 | WTSTRES SEQ ID NO: 906 | QQYYRTPWT SEQ ID NO: 1063 |
| iPS:361395 | 12H11.013 | NA | AAGTCCAGCCAGAGTGTTTTAT CCAGCTCCAACAATAAGAACTA CTTAGCT SEQ ID NO: 2320 | TGGACTTCTACCCGAGATTCC SEQ ID NO: 2477 | CAGCAATATTATCGTACTCCGT GGACG SEQ ID NO: 2634 |
| | | AA | KSSQSVLSSSNNKNYLA SEQ ID NO: 750 | WTSTRDS SEQ ID NO: 907 | QQYYRTPWT SEQ ID NO: 1064 |
| iPS:361402 | 12H11.014 | NA | AAGTCCAGCCAGAGTGTTTTAT CCAGCTCCAACAATAAGAACTA CTTAGCT SEQ ID NO: 2321 | TGGACTTCTACCCGAGAATCC SEQ ID NO: 2478 | CAGCAATATTATCGTACTCCGT GGACG SEQ ID NO: 2635 |
| | | AA | KSSQSVLSSSNNKNYLA SEQ ID NO: 751 | WTSTRES SEQ ID NO: 908 | QQYYRTPWT SEQ ID NO: 1065 |
| iPS:361406 | 2C2.005.001 | NA | TCTGGAAGTAGCTCCAACATCG GAAGTCAAACTGTAAAC SEQ ID NO: 2322 | ACTAATAATCAGCGGCCCTCA SEQ ID NO: 2479 | GCAACATTCGATGAAAGCCTG AGTGGTCCGGTA SEQ ID NO: 2636 |
| | | AA | SGSSSNIGSQTVN SEQ ID NO: 752 | TNNQRPS SEQ ID NO: 909 | ATFDESLSGPV SEQ ID NO: 1066 |
| iPS:361412 | 2C2.005.002 | NA | TCTGGAAGTAGCTCCAACATCG GAAGTCAAACTGTAAAC SEQ ID NO: 2323 | ACTAATAATCAGCGGCCCTCA SEQ ID NO: 2480 | GCAACATTCGATGAAAGCCTG CAAGGTCCGGTA SEQ ID NO: 2637 |
| | | AA | SGSSSNIGSQTVN SEQ ID NO: 753 | TNNQRPS SEQ ID NO: 910 | ATFDESLQGPV SEQ ID NO: 1067 |
| iPS:361418 | 2C2.005.003 | NA | TCTGGAAGTAGCTCCAACATCG GAAGTAATTATGTAAAC SEQ ID NO: 2324 | ACTAATAATCAGCGGCCCTCA SEQ ID NO: 2481 | GCAACATTCGATGAAAGCCTG AGTGGTCCGGTA SEQ ID NO: 2638 |
| | | AA | SGSSSNIGSNYVN SEQ ID NO: 754 | TNNQRPS SEQ ID NO: 911 | ATFDESLSGPV SEQ ID NO: 1068 |
| iPS:361424 | 2C2.005.004 | NA | TCTGGAAGTAGCTCCAACATCG GAAGTAATTATGTAAAC SEQ ID NO: 2325 | ACTAATAATCAGCGGCCCTCA SEQ ID NO: 2482 | GCAACATTCGATGAAAGCCTG CAAGGTCCGGTA SEQ ID NO: 2639 |
| | | AA | SGSSSNIGSNYVN SEQ ID NO: 755 | TNNQRPS SEQ ID NO: 912 | ATFDESLQGPV SEQ ID NO: 1069 |
| iPS:361430 | 2C2.005.005 | NA | TCTGGAAGTAGCTCCAACATCG GAAGTCAAACTGTAAAC SEQ ID NO: 2326 | ACTAATAATCAGCGGCCCTCA SEQ ID NO: 2483 | GCAACATTCGATGACAGCCTG AATGGTCCGGTA SEQ ID NO: 2640 |
| | | AA | SGSSSNIGSQTVN SEQ ID NO: 756 | TNNQRPS SEQ ID NO: 913 | ATFDDSLNGPV SEQ ID NO: 1070 |

TABLE 4A-continued

| iPS# | Ab | Type | CDRL1 | CDRL2 | CDRL3 |
|---|---|---|---|---|---|
| Exemplary CDRL1, CDRL2, and CDRL3 Nucleic Acid ("NA") and Amino Acid ("AA") Sequences | | | | | |
| iPS:361436 | 2C2.005.006 | NA | TCTGGAAGTAGCTCCAACATCG GAAGTAATTATGTAAAC SEQ ID NO: 2327 | ACTAATAATCAGCGGCCCTCA SEQ ID NO: 2484 | GCAACATTCGATGACAGCCTG AATGGTCCGGTA SEQ ID NO: 2641 |
| | | AA | SGSSSNIGSNYVN SEQ ID NO: 757 | TNNQRPS SEQ ID NO: 914 | ATFDDSLNGPV SEQ ID NO: 1071 |
| iPS:361442 | 2C2.005.007 | NA | TCTGGAAGTAGCTCCAACATCG GAAGTAATACTGTAAAC SEQ ID NO: 2328 | ACTAATAATCAGCGGCCCTCA SEQ ID NO: 2485 | GCAACATTCGATGAAAGCCTG AATGGTCCGGTA SEQ ID NO: 2642 |
| | | AA | SGSSSNIGSNTVN SEQ ID NO: 758 | TNNQRPS SEQ ID NO: 915 | ATFDESLNGPV SEQ ID NO: 1072 |
| iPS:361448 | 2C2.005.008 | NA | TCTGGAAGTAGCTCCAACATCG GAAGTAATACTGTAAAC SEQ ID NO: 2329 | ACTAATAATCAGCGGCCCTCA SEQ ID NO: 2486 | GCAACATTCGATGACAGCCTGC AAGGTCCGGTA SEQ ID NO: 2643 |
| | | AA | SGSSSNIGSNTVN SEQ ID NO: 759 | TNNQRPS SEQ ID NO: 916 | ATFDDSLQGPV SEQ ID NO: 1073 |
| iPS:361454 | 2C2.005.009 | NA | TCTGGAAGTAGCTCCAACATCG GAAGTAATACTGTAAAC SEQ ID NO: 2330 | ACTAATAATCAGCGGCCCTCA SEQ ID NO: 2487 | GCAACATTCGATGACAGCCTG AGTGGTCCGGTA SEQ ID NO: 2644 |
| | | AA | SGSSSNIGSNTVN SEQ ID NO: 760 | TNNQRPS SEQ ID NO: 917 | ATFDDSLSGPV SEQ ID NO: 1074 |
| iPS:361460 | 2C2.005.010 | NA | TCTGGAAGTAGCTCCAACATCG GAAGTAATACTGTAAAC SEQ ID NO: 2331 | ACTAATAATCAGCGGCCCTCA SEQ ID NO: 2488 | GCAACATTCGATGACAGCCTG AATGCTCCGGTA SEQ ID NO: 2645 |
| | | AA | SGSSSNIGSNTVN SEQ ID NO: 761 | TNNQRPS SEQ ID NO: 918 | ATFDDSLNAPV SEQ ID NO: 1075 |
| iPS:361466 | 2C2.005.011 | NA | TCTGGAAGTAGCTCCAACATCG GAAGTAATACTGTAAAC SEQ ID NO: 2332 | ACTAATAATCAGCGGCCCTCA SEQ ID NO: 2489 | GCAACATTCGATAGCAGCCTG AATGGTCCGGTA SEQ ID NO: 2646 |
| | | AA | SGSSSNIGSNTVN SEQ ID NO: 762 | TNNQRPS SEQ ID NO: 919 | ATFDSSLNGPV SEQ ID NO: 1076 |
| iPS:361472 | 2C2.005.012 | NA | TCTGGAAGTAGCTCCAACATCG GAAGTAATTATGTAAAC SEQ ID NO: 2333 | ACTAATAATCAGCGGCCCTCA SEQ ID NO: 2490 | GCAACATTCGATAGCAGCCTG AATGCTCCGGTA SEQ ID NO: 2647 |
| | | AA | SGSSSNIGSNYVN SEQ ID NO: 763 | TNNQRPS SEQ ID NO: 920 | ATFDSSLNAPV SEQ ID NO: 1077 |
| iPS:361478 | 2C2.005.012 | NA | TCTGGAAGTAGCTCCAACATCG GAAGTAATTATGTAAAC SEQ ID NO: 2334 | ACTAATAATCAGCGGCCCTCA SEQ ID NO: 2491 | GCAACATTCGATAGCAGCCTG AATGCTCCGGTA SEQ ID NO: 2648 |
| | | AA | SGSSSNIGSNYVN SEQ ID NO: 764 | TNNQRPS SEQ ID NO: 921 | ATFDSSLNAPV SEQ ID NO: 1078 |
| iPS:361485 | 2C2.005.014 | NA | TCTGGAAGTAGCTCCAACATCG GAAGTCAAACTGTAAAC SEQ ID NO: 2335 | ACTAATAATCAGCGGCCCTCA SEQ ID NO: 2492 | GCAACATTCGATGAAAGCCTG AGTGGTCCGGTA SEQ ID NO: 2649 |
| | | AA | SGSSSNIGSQTVN SEQ ID NO: 765 | TNNQRPS SEQ ID NO: 922 | ATFDESLSGPV SEQ ID NO: 1079 |
| iPS:361845 | 18F2.013 | NA | CGGGCAAGTCAGGACCTTAGAA ATTATTTAGGC SEQ ID NO: 2336 | GGTGCATCCAGTTTGCAAAGT SEQ ID NO: 2493 | CTACAGCATAATAATTACCCCT TCACT SEQ ID NO: 2650 |
| | | AA | RASQDLRNYLG SEQ ID NO: 766 | GASSLQS SEQ ID NO: 923 | LQHNNYPFT SEQ ID NO: 1080 |
| iPS:361851 | 6H1.009 | NA | CGGGCAAGTCAGGACATTAGAG ATTATTTAGGC SEQ ID NO: 2337 | GGTGCATCCAGTTTGCAAAGT SEQ ID NO: 2494 | CTACAGCATAATAATTACCCCT TCACT SEQ ID NO: 2651 |
| | | AA | RASQDIRDYLG SEQ ID NO: 767 | GASSLQS SEQ ID NO: 924 | LQHNNYPFT SEQ ID NO: 1081 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| iPS:361855 | 2C2.005.015 | NA | TCTGGAAGTAGCTCCAACATCG GAAGTAATACTGTAAAC SEQ ID NO: 2338 | ACTAATAATCAGCGGCCCTCA SEQ ID NO: 2495 | GCAACATTCGATAGCAGCCTG AGTGGTCCGGTA SEQ ID NO: 2652 |
| | | AA | SGSSSNIGSNTVN SEQ ID NO: 768 | TNNQRPS SEQ ID NO: 925 | ATFDSSLSGPV SEQ ID NO: 1082 |
| iPS:336067 | 5G12.006 | NA | CGGGCAAGTCAGACCATTAGCA GGTTTTTAAAT SEQ ID NO: 2339 | GTTGCATCCAGTTTGCAAAGT SEQ ID NO: 2496 | CAACAGAGTTACAGTACCCTG ATCAGT SEQ ID NO: 2653 |
| | | AA | RASQTISRFLN SEQ ID NO: 769 | VASSLQS SEQ ID NO: 926 | QQSYSTLIS SEQ ID NO: 1083 |
| iPS:336169 | 17B11.002 | NA | TCTGGAAGCAGCTCCAACATTG GAAATAATTATGTATCC SEQ ID NO: 2340 | GACAATAATAAGCGACCCTCA SEQ ID NO: 2497 | GGAACATGGGATAGCAGCCTG AGTGCTGTGGTA SEQ ID NO: 2654 |
| | | AA | SGSSSNIGNNYVS SEQ ID NO: 770 | DNNKRPS SEQ ID NO: 927 | GTWDSSLSAVV SEQ ID NO: 1084 |
| iPS:361127 | 5G12.006.001 | NA | CGGGCAAGTCAGACCATTAGCA GGTTTTTAAAT SEQ ID NO: 2341 | GTTGCATCCAGTTTGCAAAGT SEQ ID NO: 2498 | CAACAGAGTTACAGTACCCTG ATCAGT SEQ ID NO: 2655 |
| | | AA | RASQTISRFLN SEQ ID NO: 771 | VASSLQS SEQ ID NO: 928 | QQSYSTLIS SEQ ID NO: 1085 |
| iPS:361136 | 5G12.006.002 | NA | CGGGCAAGTCAGACCATTAGCA GGTTTTTAAAT SEQ ID NO: 2342 | GTTGCATCCAGTTTGCAAAGT SEQ ID NO: 2499 | CAACAGAGTTACAGTACCCTG ATCAGT SEQ ID NO: 2656 |
| | | AA | RASQTISRFLN SEQ ID NO: 772 | VASSLQS SEQ ID NO: 929 | QQSYSTLIS SEQ ID NO: 1086 |
| iPS:361140 | 5G12.006.003 | NA | CGGGCAAGTCAGACCATTAGCA GGTTTTTAAAT SEQ ID NO: 2343 | GTTGCATCCAGTTTGCAAAGT SEQ ID NO: 2500 | CAACAGAGTTACAGTACCCTG ATCAGT SEQ ID NO: 2657 |
| | | AA | RASQTISRFLN SEQ ID NO: 773 | VASSLQS SEQ ID NO: 930 | QQSYSTLIS SEQ ID NO: 1087 |
| iPS:359919 | 5G12.006.004 | NA | CGGGCAAGTCAGACCATTAGCA GGTTTTTAAAT SEQ ID NO: 2344 | GTTGCATCCAGTTTGCAAAGT SEQ ID NO: 2501 | CAACAGAGTTACAGTACCCTG ATCAGT SEQ ID NO: 2658 |
| | | AA | RASQTISRFLN SEQ ID NO: 774 | VASSLQS SEQ ID NO: 931 | QQSYSTLIS SEQ ID NO: 1088 |
| iPS:361144 | 5G12.006.005 | NA | CGGGCAAGTCAGACCATTAGCA GGTTTTTAAAT SEQ ID NO: 2345 | GTTGCATCCAGTTTGCAAAGT SEQ ID NO: 2502 | CAACAGAGTTACAGTACCCTG ATCAGT SEQ ID NO: 2659 |
| | | AA | RASQTISRFLN SEQ ID NO: 775 | VASSLQS SEQ ID NO: 932 | QQSYSTLIS SEQ ID NO: 1089 |
| iPS:361151 | 5G12.006.006 | NA | CGGGCAAGTCAGACCATTAGCA GGTTTTTAAAT SEQ ID NO: 2346 | GTTGCATCCAGTTTGCAAAGT SEQ ID NO: 2503 | CAACAGAGTTACAGTACCCTG ATCAGT SEQ ID NO: 2660 |
| | | AA | RASQTISRFLN SEQ ID NO: 776 | VASSLQS SEQ ID NO: 933 | QQSYSTLIS SEQ ID NO: 1090 |
| iPS:361491 | 17B11.002.001 | NA | TCTGGAAGCAGCTCCAACATTG GAAATAATTATGTATCC SEQ ID NO: 2347 | GACAATAATAAGCGACCCTCA SEQ ID NO: 2504 | GGAACATGGGATAGCAGCCTG AGTGCTGTGGTA SEQ ID NO: 2661 |
| | | AA | SGSSSNIGNNYVS SEQ ID NO: 777 | DNNKRPS SEQ ID NO: 934 | GTWDSSLSAVV SEQ ID NO: 1091 |
| iPS:361499 | 17B11.002.002 | NA | TCTGGAAGCAGCTCCAACATTG GAAATAATTATGTATCC SEQ ID NO: 2348 | GACAATAATAAGCGACCCTCA SEQ ID NO: 2505 | GGAACATGGGATAGCAGCCTG AGTGCTGTGGTA SEQ ID NO: 2662 |

TABLE 4A-continued

| Exemplary CDRL1, CDRL2, and CDRL3 Nucleic Acid ("NA") and Amino Acid ("AA") Sequences | | | | | |
|---|---|---|---|---|---|
| iPS# | Ab | Type | CDRL1 | CDRL2 | CDRL3 |
| | | AA | SGSSSNIGNNYVS SEQ ID NO: 778 | DNNKRPS SEQ ID NO: 935 | GTWDSSLSAVV SEQ ID NO: 1092 |
| iPS:361503 | 17B11.002.003 | NA | TCTGGAAGCAGCTCCAACATTG GAAATAATTATGTATCC SEQ ID NO: 2349 | GACAATAATAAGCGACCCTCA SEQ ID NO: 2506 | GGAACATGGGATAGCAGCCTG AGTGCTGTGGTA SEQ ID NO: 2663 |
| | | AA | SGSSSNIGNNYVS SEQ ID NO: 779 | DNNKRPS SEQ ID NO: 936 | GTWDSSLSAVV SEQ ID NO: 1093 |
| iPS:361507 | 17B11.002.004 | NA | TCTGGAAGCAGCTCCAACATTG GAAATAATTATGTATCC SEQ ID NO: 2350 | GACAATAATAAGCGACCCTCA SEQ ID NO: 2507 | GGAACATTCGAAAGCAGCCTG AGTGCTGTGGTA SEQ ID NO: 2664 |
| | | AA | SGSSSNIGNNYVS SEQ ID NO: 780 | DNNKRPS SEQ ID NO: 937 | GTFESSLSAVV SEQ ID NO: 1094 |
| iPS:361514 | 17B11.002.005 | NA | TCTGGAAGCAGCTCCAACATTG GAAATAATTATGTATCC SEQ ID NO: 2351 | GACAATAATAAGCGACCCTCA SEQ ID NO: 2508 | GGAACATGGGATAGCAGCCTG AGTGCTGTGGTA SEQ ID NO: 2665 |
| | | AA | SGSSSNIGNNYVS SEQ ID NO: 781 | DNNKRPS SEQ ID NO: 938 | GTWDSSLSAVV SEQ ID NO: 1095 |
| iPS:361582 | 17B11.002.006 | NA | TCTGGAAGCAGCTCCAACATTG GAAATAATTATGTATCC SEQ ID NO: 2352 | GACAATAATAAGCGACCCTCA SEQ ID NO: 2509 | GGAACATGGGATAGCAGCCTG AGTGCTGTGGTA SEQ ID NO: 2666 |
| | | AA | SGSSSNIGNNYVS SEQ ID NO: 782 | DNNKRPS SEQ ID NO: 939 | GTWDSSLSAVV SEQ ID NO: 1096 |
| iPS:361518 | 17B11.002.007 | NA | TCTGGAAGCAGCTCCAACATTG GAAATAATTATGTATCC SEQ ID NO: 2353 | GACAATAATAAGCGACCCTCA SEQ ID NO: 2510 | GGAACATGGGATAGCAGCCTG AGTGCTGTGGTA SEQ ID NO: 2667 |
| | | AA | SGSSSNIGNNYVS SEQ ID NO: 783 | DNNKRPS SEQ ID NO: 940 | GTWDSSLSAVV SEQ ID NO: 1097 |
| iPS:360570 | 17B11.002.008 | NA | TCTGGAAGCAGCTCCAACATTG GAAATAATTATGTATCC SEQ ID NO: 2354 | GACAATAATAAGCGACCCTCA SEQ ID NO: 2511 | GGAACATTCGAAAGCAGCCTG AGTGCTGTGGTA SEQ ID NO: 2668 |
| | | AA | SGSSSNIGNNYVS SEQ ID NO: 784 | DNNKRPS SEQ ID NO: 941 | GTFESSLSAVV SEQ ID NO: 1098 |
| iPS:362051 | 5G12.005.001 | NA | CGGGCAAGTCAGACCATTAGCA GGTTTTTAAAT SEQ ID NO: 2355 | GTTGCATCCAGTTTGCAAAGT SEQ ID NO: 2512 | CAACAGAGTTACAGTACCCTGC TCAGT SEQ ID NO: 2669 |
| | | AA | RASQTISRFLN SEQ ID NO: 785 | VASSLQS SEQ ID NO: 942 | QQSYSTLLS SEQ ID NO: 1099 |

TABLE 4B

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| iPS:336175 | 2C2.005 | NA | GGCTACTATATGCAT SEQ ID NO: 2670 | TGGATCAACCCTAACAGTGGTG GCACAAACTATGCACAGAAGT TTCAGGGC SEQ ID NO: 2827 | GGGGGGGATTACGTTTGGGGG ACTTATCGGCCTCACTACTACT ACGGTATGGACGTC SEQ ID NO: 2984 |
| | | AA | GYYMH SEQ ID NO: 1100 | WINPNSGGTNYAQKFQG SEQ ID NO: 1257 | GGDYVWGTYRPHYYYGMDV SEQ ID NO: 1414 |
| iPS:335914 | 4B1 | NA | AACTTTGGCATGCAC SEQ ID NO: 2671 | GTTATATGGTATGATGGAAGTA ATGAAAACTATGCAGACTCCGT GAAGGGC SEQ ID NO: 2828 | GATGGGACGATCTTTGGAGTGG TCTTGGGGGACTAC SEQ ID NO: 2985 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | NFGMH SEQ ID NO: 1101 | VIWYDGSNENYADSVKG SEQ ID NO: 1258 | DGTIFGVVLGDY SEQ ID NO: 1415 |
| iPS:335938 | 6H1 | NA | TACTTTGGCATGCAC SEQ ID NO: 2672 | GTTATATGGTATGATGGAAGTAATAAATACTATGCAGACTCCGTGAAGGGC SEQ ID NO: 2829 | GATGGGACGATTTTTGGAGTGCTCTTGGGGGACTAC SEQ ID NO: 2986 |
| | | AA | YFGMH SEQ ID NO: 1102 | VIWYDGSNKYYADSVKG SEQ ID NO: 1259 | DGTIFGVLLGDY SEQ ID NO: 1416 |
| iPS:335941 | 2F11 | NA | AGCTATGGCATGCAC SEQ ID NO: 2673 | GTTATATGGTATGATGGAAGTAATAAATACTATGCAGACTCCGTGAAGGGC SEQ ID NO: 2830 | GATAGGACGATTTTTGGAGTGGTTCTTGACTAC SEQ ID NO: 2987 |
| | | AA | SYGMH SEQ ID NO: 1103 | VIWYDGSNKYYADSVKG SEQ ID NO: 1260 | DRTIFGVVLDY SEQ ID NO: 1417 |
| iPS:335970 | 5C2 | NA | GGCTACTATATCCAC SEQ ID NO: 2674 | TGGATCAACCCTGACAGTGGTGGCACAGACTATTCACAGAGGTTTCAGGGC SEQ ID NO: 2831 | GAGGCCACGATTTTTGGAATGGTTATTGTACCGTTTGACTAC SEQ ID NO: 2988 |
| | | AA | GYYIH SEQ ID NO: 1104 | WINPDSGGTDYSQRFQG SEQ ID NO: 1261 | EATIFGMVIVPFDY SEQ ID NO: 1418 |
| iPS:335978 | 13H12 | NA | GGCTACTATATCCAC SEQ ID NO: 2675 | TGGATCAACCCTGACAGTGGTGGCACAGACTATTCACAGAGGTTTCAGGGC SEQ ID NO: 2832 | GAGGCCACGATTTTTGGAATGGTTATTGTACCGTTTGACTAC SEQ ID NO: 2989 |
| | | AA | GYYIH SEQ ID NO: 1105 | WINPDSGGTDYSQRFQG SEQ ID NO: 1262 | EATIFGMVIVPFDY SEQ ID NO: 1419 |
| iPS:335986 | 11C1 | NA | GGCTACTATATACAC SEQ ID NO: 2676 | TGGATCAGCCCTAACAGTGGTGACACAAGCTATGCACAGAAGTTTCAGGAC SEQ ID NO: 2833 | GAGGCCACGATTTTTGGAATGCTTATTGTACCATTTGACTAC SEQ ID NO: 2990 |
| | | AA | GYYIH SEQ ID NO: 1106 | WISPNSGDTSYAQKFQD SEQ ID NO: 1263 | EATIFGMLIVPFDY SEQ ID NO: 1420 |
| iPS:335994 | 12H11 | NA | GGCTACTATATACAC SEQ ID NO: 2677 | TGGATAAGCCCTAACAATGGTGACACAAACTATGCACAGAAGTTTCAGGAC SEQ ID NO: 2834 | GAGGCCACGATTTTTGGAATGCTTATTGTACCATTTGACTAC SEQ ID NO: 2991 |
| | | AA | GYYIH SEQ ID NO: 1107 | WISPNNGDTNYAQKFQD SEQ ID NO: 1264 | EATIFGMLIVPFDY SEQ ID NO: 1421 |
| iPS:336024 | 18E3 | NA | AGTGGTGGTTACTACTGGAGC SEQ ID NO: 2678 | TACATCTATTACAGTGGGAGCACCTACTACAACCCGTCCCTCAAGAGT SEQ ID NO: 2835 | GATCGTATTACGATTTTTGGAGTGGTTATGGGGGGCGGTATGGACGTC SEQ ID NO: 2992 |
| | | AA | SGGYYWS SEQ ID NO: 1108 | YIYYSGSTYYNPSLKS SEQ ID NO: 1265 | DRITIFGVVMGGGMDV SEQ ID NO: 1422 |
| iPS:336041 | 2G10_LC1 | NA | AACTATGGCATGCAC SEQ ID NO: 2679 | GCTATATGGTTTGATGGAAGTGATAAATACTATGCAGACTCCGTGAAGGGC SEQ ID NO: 2836 | GATCAGGCGATTTTTGGAGTGGTCCCCGACTAC SEQ ID NO: 2993 |
| | | AA | NYGMH SEQ ID NO: 1109 | AIWFDGSDKYYADSVKG SEQ ID NO: 1266 | DQAIFGVVPDY SEQ ID NO: 1423 |
| iPS:336077 | 4H9.004 | NA | TACTTTGGCATGCAC SEQ ID NO: 2680 | GTTATATGGTATGATGGAAGTAATAAATACTATGCAGACTCCGTGAAGGGC SEQ ID NO: 2837 | GATGGGACGATTTTTGGAGTGCTCTTGGGGGACTAC SEQ ID NO: 2994 |
| | | AA | YFGMH SEQ ID NO: 1110 | VIWYDGSNKYYADSVKG SEQ ID NO: 1267 | DGTIFGVLLGDY SEQ ID NO: 1424 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| iPS:336088 | 6A5.004 | NA | AGCTATGGCATGCAC SEQ ID NO: 2681 | GCTATATGGTATGATGGAAATA ATAAATACTATGCAGACTCCGT GAAGGGC SEQ ID NO: 2838 | GATCGGACGATTTTTGGAGTGG TCCTTGAGTAC SEQ ID NO: 2995 |
| | | AA | SYGMH SEQ ID NO: 1111 | AIWYDGNNKYYADSVKG SEQ ID NO: 1268 | DRTIFGVVLEY SEQ ID NO: 1425 |
| iPS:336099 | 17H11.004 | NA | AGTTACTACTGGAGC SEQ ID NO: 2682 | CGTATCTATACCAGTGGGAGCA CCAACTACAACCCCTCCCTCAA GAGT SEQ ID NO: 2839 | GATGTAGCAGTGGCTGGCTTTG ACTAC SEQ ID NO: 2996 |
| | | AA | SYYWS SEQ ID NO: 1112 | RIYTSGSTNYNPSLKS SEQ ID NO: 1269 | DVAVAGFDY SEQ ID NO: 1426 |
| iPS:359621 | 17H11.004.001 | NA | AGTTACTACTGGAGC SEQ ID NO: 2683 | CGTATCTATACCAGTGGGAGCA CCAACTACAACCCCTCCCTCAA GAGT SEQ ID NO: 2840 | GATGTAGCAGTGGCTGGCTTTG ACTAC SEQ ID NO: 2997 |
| | | AA | SYYWS SEQ ID NO: 1113 | RIYTSGSTNYNPSLKS SEQ ID NO: 1270 | DVAVAGFDY SEQ ID NO: 1427 |
| iPS:359781 | 4H9.004.001 | NA | TACTTTGGCATGCAC SEQ ID NO: 2684 | GTTATATGGTATGATGCAAGTA ATAAATACTATGCAGACGCCGT GAAGGGC SEQ ID NO: 2841 | GATGGGACGATTTTTGGAGTGC TCTTGGGGGACTAC SEQ ID NO: 2998 |
| | | AA | YFGMH SEQ ID NO: 1114 | VIWYDASNKYYADAVKG SEQ ID NO: 1271 | DGTIFGVLLGDY SEQ ID NO: 1428 |
| iPS:360929 | 4H9.004.002 | NA | TACTTTGGCATGCAC SEQ ID NO: 2685 | GTTATATGGTATGATGCAAGTA ATAAATACTATGCAGACTCCGT GAAGGGC SEQ ID NO: 2842 | GATGGGACGATTTTTGGAGTGC TCTTGGGGGACTAC SEQ ID NO: 2999 |
| | | AA | YFGMH SEQ ID NO: 1115 | VIWYDASNKYYADSVKG SEQ ID NO: 1272 | DGTIFGVLLGDY SEQ ID NO: 1429 |
| iPS:360936 | 4H9.004.003 | NA | TACTTTGGCATGCAC SEQ ID NO: 2686 | GTTATATGGTATGATGGAAGTA ATAAATACTATGCAGACGCCGT GAAGGGC SEQ ID NO: 2843 | GATGGGACGATTTTTGGAGTGC TCTTGGGGGACTAC SEQ ID NO: 3000 |
| | | AA | YFGMH SEQ ID NO: 1116 | VIWYDGSNKYYADAVKG SEQ ID NO: 1273 | DGTIFGVLLGDY SEQ ID NO: 1430 |
| iPS:360943 | 4H9.004.004 | NA | TACTTTGGCATGCAC SEQ ID NO: 2687 | GTTATATGGTATGATGCAAGTA ATAAATACTATGCAGACGCCGT GAAGGGC SEQ ID NO: 2844 | GATGGGACGATTTTTGGAGTGC TCTTGGGGGACTAC SEQ ID NO: 3001 |
| | | AA | YFGMH SEQ ID NO: 1117 | VIWYDASNKYYADAVKG SEQ ID NO: 1274 | DGTIFGVLLGDY SEQ ID NO: 1431 |
| iPS:360949 | 4H9.004.005 | NA | TACTTTGGCATGCAC SEQ ID NO: 2688 | GTTATATGGTATGATGCAAGTA ATAAATACTATGCAGACGCCGT GAAGGGC SEQ ID NO: 2845 | GATGGGACGATTTTTGGAGTGC TCTTGGGGGACTAC SEQ ID NO: 3002 |
| | | AA | YFGMH SEQ ID NO: 1118 | VIWYDASNKYYADAVKG SEQ ID NO: 1275 | DGTIFGVLLGDY SEQ ID NO: 1432 |
| iPS:359761 | 4H9.004.006 | NA | TACTTTGGCATGCAC SEQ ID NO: 2689 | GTTATATGGTATGATGCAAGTA ATAAATACTATGCAGACGCCGT GAAGGGC SEQ ID NO: 2846 | GATAGGACGATTTTTGGAGTGC TCTTGGGGGACTAC SEQ ID NO: 3003 |
| | | AA | YFGMH SEQ ID NO: 1119 | VIWYDASNKYYADAVKG SEQ ID NO: 1276 | DRTIFGVLLGDY SEQ ID NO: 1433 |
| iPS:360955 | 4B1.010 | NA | AACTTTGGCATGCAC SEQ ID NO: 2690 | GTTATATGGTATGATGCAAGTA ATGAAAACTATGCAGACGCCG TGAAGGGC SEQ ID NO: 2847 | GATGGGACGATCTTTGGAGTGG TCTTGGGGGACTAC SEQ ID NO: 3004 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | NFGMH SEQ ID NO: 1120 | VIWYDASNENYADAVKG SEQ ID NO: 1277 | DGTIFGVVLGDY SEQ ID NO: 1434 |
| iPS:360962 | 4B1.011 | NA | AACTTTGGCATGCAC SEQ ID NO: 2691 | GTTATATGGTATGATGCAAGTAATGAAAACTATGCAGACGCCGTGAAGGGC SEQ ID NO: 2848 | GATGGGACGATCTTTGGAGTGGTCTTGGGGGACTAC SEQ ID NO: 3005 |
| | | AA | FNGMH SEQ ID NO: 1121 | VIWYDASNENYADAVKG SEQ ID NO: 1278 | DGTIFGVVLGDY SEQ ID NO: 1435 |
| iPS:360968 | 4B1.012 | NA | AACTTTGGCATGCAC SEQ ID NO: 2692 | GTTATATGGTATGATGCAAGTAATGAAAACTATGCAGACGCCGTGAAGGGC SEQ ID NO: 2849 | GATGGGACGATCTTTGGAGTGGTCTTGGGGGACTAC SEQ ID NO: 3006 |
| | | AA | NFGMH SEQ ID NO: 1122 | VIWYDASNENYADAVKG SEQ ID NO: 1279 | DGTIFGVVLGDY SEQ ID NO: 1436 |
| iPS:360974 | 4B1.013 | NA | AACTTTGGCATGCAC SEQ ID NO: 2693 | GTTATATGGTATGATGCAAGTAATGAAAACTATGCAGACTCCGTGAAGGGC SEQ ID NO: 2850 | GATGGGACGATCTTTGGAGTGGTCTTGGGGGACTAC SEQ ID NO: 3007 |
| | | AA | NFGMH SEQ ID NO: 1123 | VIWYDASNENYADSVKG SEQ ID NO: 1280 | DGTIFGVVLGDY SEQ ID NO: 1437 |
| iPS:360978 | 4B1.014 | NA | AACTTTGGCATGCAC SEQ ID NO: 2694 | GTTATATGGTATGATGGAAGTAATGAAAACTATGCAGACGCCGTGAAGGGC SEQ ID NO: 2851 | GATGGGACGATCTTTGGAGTGGTCTTGGGGGACTAC SEQ ID NO: 3008 |
| | | AA | NFGMH SEQ ID NO: 1124 | VIWYDGSNENYADAVKG SEQ ID NO: 1281 | DGTIFGVVLGDY SEQ ID NO: 1438 |
| iPS:359785 | 4B1.015 | NA | AACTTTGGCATGCAC SEQ ID NO: 2695 | GTTATATGGTATGATGCAAGTAATGAAAACTATGCAGACGCCGTGAAGGGC SEQ ID NO: 2852 | GATAGGACGATCTTTGGAGTGGTCTTGGGGGACTAC SEQ ID NO: 3009 |
| | | AA | NFGMH SEQ ID NO: 1125 | VIWYDASNENYADAVKG SEQ ID NO: 1282 | DRTIFGVVLGDY SEQ ID NO: 1439 |
| iPS:360982 | 4B1.016 | NA | AACTTTGGCATGCAC SEQ ID NO: 2696 | GTTATATGGTATGATGCAAGTAATGAAAACTATGCAGACGCCGTGAAGGGC SEQ ID NO: 2853 | GATGGGACGATCTTTGGAGTGGTCTTGGGGGACTAC SEQ ID NO: 3010 |
| | | AA | NFGMH SEQ ID NO: 1126 | VIWYDASNENYADAVKG SEQ ID NO: 1283 | DGTIFGVVLGDY SEQ ID NO: 1440 |
| iPS:335922 | 18F2 | NA | AACTTTGGCATGCAC SEQ ID NO: 2697 | GTTATATGGTATGATGGAAGTAATGAAAACTATGCAGACTCCGTGAAGGGC SEQ ID NO: 2854 | GATGGGACGATCTTTGGAGTGGTCTTGGGGGACTAC SEQ ID NO: 3011 |
| | | AA | NFGMH SEQ ID NO: 1127 | VIWYDGSNENYADSVKG SEQ ID NO: 1284 | DGTIFGVVLGDY SEQ ID NO: 1441 |
| iPS:360986 | 18F2.002 | NA | AACTTTGGCATGCAC SEQ ID NO: 2698 | GTTATATGGTATGATGCAAGTAATGAAAACTATGCAGACGCCGTGAAGGGC SEQ ID NO: 2855 | GATGGGACGATCTTTGGAGTGGTCTTGGGGGACTAC SEQ ID NO: 3012 |
| | | AA | NFGMH SEQ ID NO: 1128 | VIWYDASNENYADAVKG SEQ ID NO: 1285 | DGTIFGVVLGDY SEQ ID NO: 1442 |
| iPS:360995 | 18F2.003 | NA | AACTTTGGCATGCAC SEQ ID NO: 2699 | GTTATATGGTATGATGCAAGTAATGAAAACTATGCAGACGCCGTGAAGGGC SEQ ID NO: 2856 | GATGGGACGATCTTTGGAGTGGTCTTGGGGGACTAC SEQ ID NO: 3013 |
| | | AA | NFGMH SEQ ID NO: 1129 | VIWYDASNENYADAVKG SEQ ID NO: 1286 | DGTIFGVVLGDY SEQ ID NO: 1443 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| iPS:360999 | 18F2.004 | NA | AACTTTGGCATGCAC SEQ ID NO: 2700 | GTTATATGGTATGATGCAAGTA ATGAAAACTATGCAGACGCCG TGAAGGGC SEQ ID NO: 2857 | GATGGGACGATCTTTGGAGTGG TCTTGGGGGACTAC SEQ ID NO: 3014 |
| | | AA | NFGMH SEQ ID NO: 1130 | VIWYDASNENYADAVKG SEQ ID NO: 1287 | DGTIFGVVLGDY SEQ ID NO: 1444 |
| iPS:361005 | 18F2.005 | NA | AACTTTGGCATGCAC SEQ ID NO: 2701 | GTTATATGGTATGATGCAAGTA ATGAAAACTATGCAGACGCCG TGAAGGGC SEQ ID NO: 2858 | GATGGGACGATCTTTGGAGTGG TCTTGGGGGACTAC SEQ ID NO: 3015 |
| | | AA | NFGMH SEQ ID NO: 1131 | VIWYDASNENYADAVKG SEQ ID NO: 1288 | DGTIFGVVLGDY SEQ ID NO: 1445 |
| iPS:361009 | 18F2.006 | NA | AACTTTGGCATGCAC SEQ ID NO: 2702 | GTTATATGGTATGATGCAAGTA ATGAAAACTATGCAGACGCCG TGAAGGGC SEQ ID NO: 2859 | GATGGGACGATCTTTGGAGTGG TCTTGGGGGACTAC SEQ ID NO: 3016 |
| | | AA | NFGMH SEQ ID NO: 1132 | VIWYDASNENYADAVKG SEQ ID NO: 1289 | DGTIFGVVLGDY SEQ ID NO: 1446 |
| iPS:361013 | 18F2.007 | NA | AACTTTGGCATGCAC SEQ ID NO: 2703 | GTTATATGGTATGATGCAAGTA ATGAAAACTATGCAGACGCCG TGAAGGGC SEQ ID NO: 2860 | GATGGGACGATCTTTGGAGTGG TCTTGGGGGACTAC SEQ ID NO: 3017 |
| | | AA | NFGMH SEQ ID NO: 1133 | VIWYDASNENYADAVKG SEQ ID NO: 1290 | DGTIFGVVLGDY SEQ ID NO: 1447 |
| iPS:361017 | 18F2.008 | NA | AACTTTGGCATGCAC SEQ ID NO: 2704 | GTTATATGGTATGATGCAAGTA ATGAAAACTATGCAGACGCCG TGAAGGGC SEQ ID NO: 2861 | GATGGGACGATCTTTGGAGTGG TCTTGGGGGACTAC SEQ ID NO: 3018 |
| | | AA | NFGMH SEQ ID NO: 1134 | VIWYDASNENYADAVKG SEQ ID NO: 1291 | DGTIFGVVLGDY SEQ ID NO: 1448 |
| iPS:361021 | 18F2.009 | NA | AACTTTGGCATGCAC SEQ ID NO: 2705 | GTTATATGGTATGATGGAAGTA ATGAAAACTATGCAGACGCCG TGAAGGGC SEQ ID NO: 2862 | GATGGGACGATCTTTGGAGTGG TCTTGGGGGACTAC SEQ ID NO: 3019 |
| | | AA | NFGMH SEQ ID NO: 1135 | VIWYDGSNENYADAVKG SEQ ID NO: 1292 | DGTIFGVVLGDY SEQ ID NO: 1449 |
| iPS:361028 | 18F2.010 | NA | AACTTTGGCATGCAC SEQ ID NO: 2706 | GTTATATGGTATGATGCAAGTA ATGAAAACTATGCAGACTCCGT GAAGGGC SEQ ID NO: 2863 | GATGGGACGATCTTTGGAGTGG TCTTGGGGGACTAC SEQ ID NO: 3020 |
| | | AA | NFGMH SEQ ID NO: 1136 | VIWYDASNENYADSVKG SEQ ID NO: 1293 | DGTIFGVVLGDY SEQ ID NO: 1450 |
| iPS:360535 | 18F2.011 | NA | AACTTTGGCATGCAC SEQ ID NO: 2707 | GTTATATGGTATGATGCAAGTA ATGAAAACTATGCAGACGCCG TGAAGGGC SEQ ID NO: 2864 | GATAGGACGATCTTTGGAGTGG TCTTGGGGGACTAC SEQ ID NO: 3021 |
| | | AA | NFGMH SEQ ID NO: 1137 | VIWYDASNENYADAVKG SEQ ID NO: 1294 | DRTIFGVVLGDY SEQ ID NO: 1451 |
| iPS:361035 | 18F2.012 | NA | AACTTTGGCATGCAC SEQ ID NO: 2708 | GTTATATGGTATGATGCAAGTA ATGAAAACTATGCAGACGCCG TGAAGGGC SEQ ID NO: 2865 | GATGGGACGATCTTTGGAGTGG TCTTGGGGGACTAC SEQ ID NO: 3022 |
| | | AA | NFGMH SEQ ID NO: 1138 | VIWYDASNENYADAVKG SEQ ID NO: 1295 | DGTIFGVVLGDY SEQ ID NO: 1452 |
| iPS:359940 | 2F11.002 | NA | AGCTATGGCATGCAC SEQ ID NO: 2709 | GTTATATGGTATGATGCAAGTA ATAAATACTATGCAGACGCCGT GAAGGGC SEQ ID NO: 2866 | GATAGGACGATTTTTGGAGTGG TTCTTGACTAC SEQ ID NO: 3023 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | SYGMH SEQ ID NO: 1139 | VIWYDASNKYYADAVKG SEQ ID NO: 1296 | DRTIFGVVLDY SEQ ID NO: 1453 |
| iPS:361039 | 2F11.003 | NA | AGCTATGGCATGCAC SEQ ID NO: 2710 | GTTATATGGTATGATGCAAGTA ATAAATACTATGCAGACGCCGT GAAGGGC SEQ ID NO: 2867 | GATAGGACGATTTTTGGAGTGG TTCTTGACTAC SEQ ID NO: 3024 |
| | | AA | SYGMH SEQ ID NO: 1140 | VIWYDASNKYYADAVKG SEQ ID NO: 1297 | DRTIFGVVLDY SEQ ID NO: 1454 |
| iPS:361043 | 2F11.004 | NA | AGCTATGGCATGCAC SEQ ID NO: 2711 | GTTATATGGTATGATGCAAGTA ATAAATACTATGCAGACGCCGT GAAGGGC SEQ ID NO: 2868 | GATAGGACGATTTTTGGAGTGG TTCTTGACTAC SEQ ID NO: 3025 |
| | | AA | SYGMH SEQ ID NO: 1141 | VIWYDASNKYYADAVKG SEQ ID NO: 1298 | DRTIFGVVLDY SEQ ID NO: 1455 |
| iPS:361049 | 2F11.005 | NA | AGCTATGGCATGCAC SEQ ID NO: 2712 | GTTATATGGTATGATGCAAGTA ATAAATACTATGCAGACGCCGT GAAGGGC SEQ ID NO: 2869 | GATAGGACGATTTTTGGAGTGG TTCTTGACTAC SEQ ID NO: 3026 |
| | | AA | SYGMH SEQ ID NO: 1142 | VIWYDASNKYYADAVKG SEQ ID NO: 1299 | DRTIFGVVLDY SEQ ID NO: 1456 |
| iPS:361055 | 2F11.006 | NA | AGCTATGGCATGCAC SEQ ID NO: 2713 | GTTATATGGTATGATGCAAGTA ATAAATACTATGCAGACGCCGT GAAGGGC SEQ ID NO: 2870 | GATAGGACGATTTTTGGAGTGG TTCTTGACTAC SEQ ID NO: 3027 |
| | | AA | SYGMH SEQ ID NO: 1143 | VIWYDASNKYYADAVKG SEQ ID NO: 1300 | DRTIFGVVLDY SEQ ID NO: 1457 |
| iPS:361059 | 2F11.007 | NA | AGCTATGGCATGCAC SEQ ID NO: 2714 | GTTATATGGTATGATGCAAGTA ATAAATACTATGCAGACGCCGT GAAGGGC SEQ ID NO: 2871 | GATAGGACGATTTTTGGAGTGG TTCTTGACTAC SEQ ID NO: 3028 |
| | | AA | SYGMH SEQ ID NO: 1144 | VIWYDASNKYYADAVKG SEQ ID NO: 1301 | DRTIFGVVLDY SEQ ID NO: 1458 |
| iPS:361063 | 2F11.008 | NA | AGCTATGGCATGCAC SEQ ID NO: 2715 | GTTATATGGTATGATGCAAGTA ATAAATACTATGCAGACGCCGT GAAGGGC SEQ ID NO: 2872 | GATAGGACGATTTTTGGAGTGG TTCTTGACTAC SEQ ID NO: 3029 |
| | | AA | SYGMH SEQ ID NO: 1145 | VIWYDASNKYYADAVKG SEQ ID NO: 1302 | DRTIFGVVLDY SEQ ID NO: 1459 |
| iPS:359949 | 2F11.009 | NA | AGCTATGGCATGCAC SEQ ID NO: 2716 | GTTATATGGTATGATGCAAGTA ATAAATACTATGCAGACTCCGT GAAGGGC SEQ ID NO: 2873 | GATAGGACGATTTTTGGAGTGG TTCTTGACTAC SEQ ID NO: 3030 |
| | | AA | SYGMH SEQ ID NO: 1146 | VIWYDASNKYYADSVKG SEQ ID NO: 1303 | DRTIFGVVLDY SEQ ID NO: 1460 |
| iPS:359956 | 2F11.010 | NA | AGCTATGGCATGCAC SEQ ID NO: 2717 | GTTATATGGTATGATGGAAGTA ATAAATACTATGCAGACGCCGT GAAGGGC SEQ ID NO: 2874 | GATAGGACGATTTTTGGAGTGG TTCTTGACTAC SEQ ID NO: 3031 |
| | | AA | SYGMH SEQ ID NO: 1147 | VIWYDGSNKYYADAVKG SEQ ID NO: 1304 | DRTIFGVVLDY SEQ ID NO: 1461 |
| iPS:359865 | 6H1.002 | NA | TACTTTGGCATGCAC SEQ ID NO: 2718 | GTTATATGGTATGATGCAAGTA ATAAATACTATGCAGACGCCGT GAAGGGC SEQ ID NO: 2875 | GATGGGACGATTTTTGGAGTGC TCTTGGGGGACTAC SEQ ID NO: 3032 |
| | | AA | YFGMH SEQ ID NO: 1148 | VIWYDASNKYYADAVKG SEQ ID NO: 1305 | DGTIFGVLLGDY SEQ ID NO: 1462 |

TABLE 4B-continued

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| iPS:359869 | 6H1.003 | NA | TACTTTGGCATGCAC SEQ ID NO: 2719 | GTTATATGGTATGATGCAAGTA ATAAATACTATGCAGACGCCGT GAAGGGC SEQ ID NO: 2876 | GATAGGACGATTTTTGGAGTGC TCTTGGGGGACTAC SEQ ID NO: 3033 |
| | | AA | YFGMH SEQ ID NO: 1149 | VIWYDASNKYYADAVKG SEQ ID NO: 1306 | DRTIFGVLLGDY SEQ ID NO: 1463 |
| iPS:359873 | 6H1.004 | NA | TACTTTGGCATGCAC SEQ ID NO: 2720 | GTTATATGGTATGATGCAAGTA ATAAATACTATGCAGACGCCGT GAAGGGC SEQ ID NO: 2877 | GATGGGACGATTTTTGGAGTGC TCTTGGGGGACTAC SEQ ID NO: 3034 |
| | | AA | YFGMH SEQ ID NO: 1150 | VIWYDASNKYYADAVKG SEQ ID NO: 1307 | DGTIFGVLLGDY SEQ ID NO: 1464 |
| iPS:359877 | 6H1.005 | NA | TACTTTGGCATGCAC SEQ ID NO: 2721 | GTTATATGGTATGATGCAAGTA ATAAATACTATGCAGACGCCGT GAAGGGC SEQ ID NO: 2878 | GATAGGACGATTTTTGGAGTGC TCTTGGGGGACTAC SEQ ID NO: 3035 |
| | | AA | YFGMH SEQ ID NO: 1151 | VIWYDASNKYYADAVKG SEQ ID NO: 1308 | DRTIFGVLLGDY SEQ ID NO: 1465 |
| iPS:361067 | 6H1.006 | NA | TACTTTGGCATGCAC SEQ ID NO: 2722 | GTTATATGGTATGATGGAAGTA ATAAATACTATGCAGACTCCGT GAAGGGC SEQ ID NO: 2879 | GATGGGACGATTTTTGGAGTGC TCTTGGGGGACTAC SEQ ID NO: 3036 |
| | | AA | YFGMH SEQ ID NO: 1152 | VIWYDGSNKYYADSVKG SEQ ID NO: 1309 | DGTIFGVLLGDY SEQ ID NO: 1466 |
| iPS:361071 | 6H1.007 | NA | TACTTTGGCATGCAC SEQ ID NO: 2723 | GTTATATGGTATGATGCAAGTA ATAAATACTATGCAGACTCCGT GAAGGGC SEQ ID NO: 2880 | GATGGGACGATTTTTGGAGTGC TCTTGGGGGACTAC SEQ ID NO: 3037 |
| | | AA | YFGMH SEQ ID NO: 1153 | VIWYDASNKYYADSVKG SEQ ID NO: 1310 | DGTIFGVLLGDY SEQ ID NO: 1467 |
| iPS:361075 | 6H1.008 | NA | TACTTTGGCATGCAC SEQ ID NO: 2724 | GTTATATGGTATGATGGAAGTA ATAAATACTATGCAGACGCCGT GAAGGGC SEQ ID NO: 2881 | GATGGGACGATTTTTGGAGTGC TCTTGGGGGACTAC SEQ ID NO: 3038 |
| | | AA | YFGMH SEQ ID NO: 1154 | VIWYDGSNKYYADAVKG SEQ ID NO: 1311 | DGTIFGVLLGDY SEQ ID NO: 1468 |
| iPS:361079 | 6A5.004.001 | NA | AGCTATGGCATGCAC SEQ ID NO: 2725 | GCTATATGGTATGATGCAAATA ATAAATACTATGCAGACGCCGT GAAGGGC SEQ ID NO: 2882 | GATCGGACGATTTTTGGAGTGG TCCTTGAGTAC SEQ ID NO: 3039 |
| | | AA | SYGMH SEQ ID NO: 1155 | AIWYDANNKYYADAVKG SEQ ID NO: 1312 | DRTIFGVVLEY SEQ ID NO: 1469 |
| iPS:361085 | 6A5.004.002 | NA | AGCTATGGCATGCAC SEQ ID NO: 2726 | GCTATATGGTATGATGCAAATA ATAAATACTATGCAGACGCCGT GAAGGGC SEQ ID NO: 2883 | GATCGGACGATTTTTGGAGTGG TCCTTGAGTAC SEQ ID NO: 3040 |
| | | AA | SYGMH SEQ ID NO: 1156 | AIWYDANNKYYADAVKG SEQ ID NO: 1313 | DRTIFGVVLEY SEQ ID NO: 1470 |
| iPS:361091 | 6A5.004.003 | NA | AGCTATGGCATGCAC SEQ ID NO: 2727 | GCTATATGGTATGATGCAAATA ATAAATACTATGCAGACGCCGT GAAGGGC SEQ ID NO: 2884 | GATCGGACGATTTTTGGAGTGG TCCTTGAGTAC SEQ ID NO: 3041 |
| | | AA | SYGMH SEQ ID NO: 1157 | AIWYDANNKYYADAVKG SEQ ID NO: 1314 | DRTIFGVVLEY SEQ ID NO: 1471 |
| iPS:361095 | 6A5.004.004 | NA | AGCTATGGCATGCAC SEQ ID NO: 2728 | GCTATATGGTATGATGCAAATA ATAAATACTATGCAGACGCCGT GAAGGGC SEQ ID NO: 2885 | GATCGGACGATTTTTGGAGTGG TCCTTGAGTAC SEQ ID NO: 3042 |

TABLE 4B-continued

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| | | AA | SYGMH SEQ ID NO: 1158 | AIWYDANNKYYADAVKG SEQ ID NO: 1315 | DRTIFGVVLEY SEQ ID NO: 1472 |
| iPS:361101 | 6A5.004.005 | NA | AGCTATGGCATGCAC SEQ ID NO: 2729 | GCTATATGGTATGATGCAAATA ATAAATACTATGCAGACGCCGT GAAGGGC SEQ ID NO: 2886 | GATCGGACGATTTTGGAGTGG TCCTTGAGTAC SEQ ID NO: 3043 |
| | | AA | SYGMH SEQ ID NO: 1159 | AIWYDANNKYYADAVKG SEQ ID NO: 1316 | DRTIFGVVLEY SEQ ID NO: 1473 |
| iPS:361105 | 6A5.004.006 | NA | AGCTATGGCATGCAC SEQ ID NO: 2730 | GCTATATGGTATGATGCAAATA ATAAATACTATGCAGACGCCGT GAAGGGC SEQ ID NO: 2887 | GATCGGACGATTTTGGAGTGG TCCTTGAGTAC SEQ ID NO: 3044 |
| | | AA | SYGMH SEQ ID NO: 1160 | AIWYDANNKYYADAVKG SEQ ID NO: 1317 | DRTIFGVVLEY SEQ ID NO: 1474 |
| iPS:361109 | 6A5.004.007 | NA | AGCTATGGCATGCAC SEQ ID NO: 2731 | GCTATATGGTATGATGCAAATA ATAAATACTATGCAGACGCCGT GAAGGGC SEQ ID NO: 2888 | GATCGGACGATTTTGGAGTGG TCCTTGAGTAC SEQ ID NO: 3045 |
| | | AA | SYGMH SEQ ID NO: 1161 | AIWYDANNKYYADAVKG SEQ ID NO: 1318 | DRTIFGVVLEY SEQ ID NO: 1475 |
| iPS:361113 | 6A5.004.008 | NA | AGCTATGGCATGCAC SEQ ID NO: 2732 | GCTATATGGTATGATGGAAATA ATAAATACTATGCAGACGCCGT GAAGGGC SEQ ID NO: 2889 | GATCGGACGATTTTGGAGTGG TCCTTGAGTAC SEQ ID NO: 3046 |
| | | AA | SYGMH SEQ ID NO: 1162 | AIWYDGNNKYYADAVKG SEQ ID NO: 1319 | DRTIFGVVLEY SEQ ID NO: 1476 |
| iPS:361120 | 6A5.004.009 | NA | AGCTATGGCATGCAC SEQ ID NO: 2733 | GCTATATGGTATGATGCAAATA ATAAATACTATGCAGACTCCGT GAAGGGC SEQ ID NO: 2890 | GATCGGACGATTTTGGAGTGG TCCTTGAGTAC SEQ ID NO: 3047 |
| | | AA | SYGMH SEQ ID NO: 1163 | AIWYDANNKYYADSVKG SEQ ID NO: 1320 | DRTIFGVVLEY SEQ ID NO: 1477 |
| iPS:359896 | 6A5.004.010 | NA | AGCTATGGCATGCAC SEQ ID NO: 2734 | GCTATATGGTATGATGCAAATA ATAAATACTATGCAGACGCCGT GAAGGGC SEQ ID NO: 2891 | GATCGGACGATTTTGGAGTGG TCCTTGAGTAC SEQ ID NO: 3048 |
| | | AA | SYGMH SEQ ID NO: 1164 | AIWYDANNKYYADAVKG SEQ ID NO: 1321 | DRTIFGVVLEY SEQ ID NO: 1478 |
| iPS:359890 | 6A5.004.011 | NA | AGCTATGGCATGCAC SEQ ID NO: 2735 | GCTATATGGTATGATGCAAATA ATAAATACTATGCAGACGCCGT GAAGGGC SEQ ID NO: 2892 | GATCGGACGATTTTGGAGTGG TCCTTGAGTAC SEQ ID NO: 3049 |
| | | AA | SYGMH SEQ ID NO: 1165 | AIWYDANNKYYADAVKG SEQ ID NO: 1322 | DRTIFGVVLEY SEQ ID NO: 1479 |
| iPS:359567 | 2A11.002 | NA | AGCTATGGCATGCAC SEQ ID NO: 2736 | GTTATATGGTATGATGCAAGTA ATAAATACTATGAAGACGCCGT GAAGGGC SEQ ID NO: 2893 | GGGATTACGATTTTTGGTCATG GGTTTGAATAT SEQ ID NO: 3050 |
| | | AA | SYGMH SEQ ID NO: 1166 | VIWYDASNKYYEDAVKG SEQ ID NO: 1323 | GITIFGHGFEY SEQ ID NO: 1480 |
| iPS:335965 | 2A11.003 | NA | AGCTATGGCATGCAC SEQ ID NO: 2737 | GTTATATGGTATGATGGAAGTA ATAAATACTATGAAGACTCCGT GAAGGGC SEQ ID NO: 2894 | GGGATTACGATTTTTGGTCATG GGTTTGAATAT SEQ ID NO: 3051 |
| | | AA | SYGMH SEQ ID NO: 1167 | VIWYDGSNKYYEDSVKG SEQ ID NO: 1324 | GITIFGHGFEY SEQ ID NO: 1481 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| iPS:361158 | 2A11.004 | NA | AGCTATGGCATGCAC SEQ ID NO: 2738 | GTTATATGGTATGATGGAAGTA ATAAATACTATGAAGACGCCGT GAAGGGC SEQ ID NO: 2895 | GGGATTACGATTTTTGGTCATG GGTTTGAATAT SEQ ID NO: 3052 |
| | | AA | SYGMH SEQ ID NO: 1168 | VIWYDGSNKYYEDAVKG SEQ ID NO: 1325 | GITIFGHGFEY SEQ ID NO: 1482 |
| iPS:361165 | 2A11.005 | NA | AGCTATGGCATGCAC SEQ ID NO: 2739 | GTTATATGGTATGATGCAAGTA ATAAATACTATGAAGACTCCGT GAAGGGC SEQ ID NO: 2896 | GGGATTACGATTTTTGGTCATG GGTTTGAATAT SEQ ID NO: 3053 |
| | | AA | SYGMH SEQ ID NO: 1169 | VIWYDASNKYYEDSVKG SEQ ID NO: 1326 | GITIFGHGFEY SEQ ID NO: 1483 |
| iPS:361172 | 2G10_LC1.003 | NA | AACTATGGCATGCAC SEQ ID NO: 2740 | GCTATATGGTTTGATGCAAGTG ATAAATACTATGCAGACGCCGT GAAGGGC SEQ ID NO: 2897 | GATCAGGCGATTTTTGGAGTGG TCCCCGACTAC SEQ ID NO: 3054 |
| | | AA | NYGMH SEQ ID NO: 1170 | AIWFDASDKYYADAVKG SEQ ID NO: 1327 | DQAIFGVVPDY SEQ ID NO: 1484 |
| iPS:361178 | 2G10_LC1.004 | NA | AACTATGGCATGCAC SEQ ID NO: 2741 | GCTATATGGTTTGATGCAAGTG ATAAATACTATGCAGACTCCGT GAAGGGC SEQ ID NO: 2898 | GATCAGGCGATTTTTGGAGTGG TCCCCGACTAC SEQ ID NO: 3055 |
| | | AA | NYGMH SEQ ID NO: 1171 | AIWFDASDKYYADSVKG SEQ ID NO: 1328 | DQAIFGVVPDY SEQ ID NO: 1485 |
| iPS:361185 | 2G10_LC1.005 | NA | AACTATGGCATGCAC SEQ ID NO: 2742 | GCTATATGGTTTGATGGAAGTG ATAAATACTATGCAGACGCCGT GAAGGGC SEQ ID NO: 2899 | GATCAGGCGATTTTTGGAGTGG TCCCCGACTAC SEQ ID NO: 3056 |
| | | AA | NYGMH SEQ ID NO: 1172 | AIWFDGSDKYYADAVKG SEQ ID NO: 1329 | DQAIFGVVPDY SEQ ID NO: 1486 |
| iPS:361192 | 2G10_LC1.006 | NA | AACTATGGCATGCAC SEQ ID NO: 2743 | GCTATATGGTTTGATGCAAGTG ATAAATACTATGCAGACGCCGT GAAGGGC SEQ ID NO: 2900 | GATCAGGCGATTTTTGGAGTGG TCCCCGACTAC SEQ ID NO: 3057 |
| | | AA | NYGMH SEQ ID NO: 1173 | AIWFDASDKYYADAVKG SEQ ID NO: 1330 | DQAIFGVVPDY SEQ ID NO: 1487 |
| iPS:359609 | 2G10_LC1.007 | NA | AACTATGGCATGCAC SEQ ID NO: 2744 | GCTATATGGTTTGATGCAAGTG ATAAATACTATGCAGACGCCGT GAAGGGC SEQ ID NO: 2901 | GATCAGGCGATTTTTGGAGTGG TCCCCGACTAC SEQ ID NO: 3058 |
| | | AA | NYGMH SEQ ID NO: 1174 | AIWFDASDKYYADAVKG SEQ ID NO: 1331 | DQAIFGVVPDY SEQ ID NO: 1488 |
| iPS:359615 | 2G10_LC1.008 | NA | AACTATGGCATGCAC SEQ ID NO: 2745 | GCTATATGGTTTGATGCAAGTG ATAAATACTATGCAGACGCCGT GAAGGGC SEQ ID NO: 2902 | GATCAGGCGATTTTTGGAGTGG TCCCCGACTAC SEQ ID NO: 3059 |
| | | AA | NYGMH SEQ ID NO: 1175 | AIWFDASDKYYADAVKG SEQ ID NO: 1332 | DQAIFGVVPDY SEQ ID NO: 1489 |
| iPS:361196 | 2G10_LC1.009 | NA | AACTATGGCATGCAC SEQ ID NO: 2746 | GCTATATGGTTTGATGCAAGTG ATAAATACTATGCAGACGCCGT GAAGGGC SEQ ID NO: 2903 | GATCAGGCGATTTTTGGAGTGG TCCCCGACTAC SEQ ID NO: 3060 |
| | | AA | NYGMH SEQ ID NO: 1176 | AIWFDASDKYYADAVKG SEQ ID NO: 1333 | DQAIFGVVPDY SEQ ID NO: 1490 |
| iPS:361202 | 2G10_LC1.010 | NA | AACTATGGCATGCAC SEQ ID NO: 2747 | GCTATATGGTTTGATGCAAGTG ATAAATACTATGCAGACGCCGT GAAGGGC SEQ ID NO: 2904 | GATCAGGCGATTTTTGGAGTGG TCCCCGACTAC SEQ ID NO: 3061 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | NYGMH SEQ ID NO: 1177 | AIWFDASDKYYADAVKG SEQ ID NO: 1334 | DQAIFGVVPDY SEQ ID NO: 1491 |
| iPS:359644 | 18E3.002 | NA | AGTGGTGGTTACTACTGGAGC SEQ ID NO: 2748 | TACATCTATTACAGTGGGAGCACCTACTACAACCCGTCCCTCAAGAGT SEQ ID NO: 2905 | GATCGTATTACGATTTTTGGAGTGGTTATGGGGGGCGGTATGGACGTC SEQ ID NO: 3062 |
| | | AA | SGGYYWS SEQ ID NO: 1178 | YIYYSGSTYYNPSLKS SEQ ID NO: 1335 | DRITIFGVVMGGGMDV SEQ ID NO: 1492 |
| iPS:361206 | 18E3.003 | NA | AGTGGTGGTTACTACTGGAGC SEQ ID NO: 2749 | TACATCTATTACAGTGGGAGCACCTACTACAACCCGTCCCTCAAGAGT SEQ ID NO: 2906 | GATCGTATTACGATTTTTGGAGTGGTTATGGGGGGCGGTATGGACGTC SEQ ID NO: 3063 |
| | | AA | SGGYYWS SEQ ID NO: 1179 | YIYYSGSTYYNPSLKS SEQ ID NO: 1336 | DRITIFGVVMGGGMDV SEQ ID NO: 1493 |
| iPS:359628 | 18E3.004 | NA | AGTGGTGGTTACTACTGGAGC SEQ ID NO: 2750 | TACATCTATTACAGTGGGAGCACCTACTACAACCCGTCCCTCAAGAGT SEQ ID NO: 2907 | GATCGTATTACGATTTTTGGAGTGGTTATGGGGGGCGGTATGGACGTC SEQ ID NO: 3064 |
| | | AA | SGGYYWS SEQ ID NO: 1180 | YIYYSGSTYYNPSLKS SEQ ID NO: 1337 | DRITIFGVVMGGGMDV SEQ ID NO: 1494 |
| iPS:359637 | 18E3.005 | NA | AGTGGTGGTTACTACTGGAGC SEQ ID NO: 2751 | TACATCTATTACAGTGGGAGCACCTACTACAACCCGTCCCTCAAGAGT SEQ ID NO: 2908 | GATCGTATTACGATTTTTGGAGTGGTTATGGGGGGCGGTATGGACGTC SEQ ID NO: 3065 |
| | | AA | SGGYYWS SEQ ID NO: 1181 | YIYYSGSTYYNPSLKS SEQ ID NO: 1338 | DRITIFGVVMGGGMDV SEQ ID NO: 1495 |
| iPS:361210 | 18E3.006 | NA | AGTGGTGGTTACTACTGGAGC SEQ ID NO: 2752 | TACATCTATTACAGTGGGAGCACCTACTACAACCCGTCCCTCAAGAGT SEQ ID NO: 2909 | GATCGTATTACGATTTTTGGAGTGGTTATGGGGGGCGGTATGGACGTC SEQ ID NO: 3066 |
| | | AA | SGGYYWS SEQ ID NO: 1182 | YIYYSGSTYYNPSLKS SEQ ID NO: 1339 | DRITIFGVVMGGGMDV SEQ ID NO: 1496 |
| iPS:361214 | 18E3.007 | NA | AGTGGTGGTTACTACTGGAGC SEQ ID NO: 2753 | TACATCTATTACAGTGGGAGCACCTACTACAACCCGTCCCTCAAGAGT SEQ ID NO: 2910 | GATCGTATTACGATTTTTGGAGTGGTTATGGGGGGCGGTATGGACGTC SEQ ID NO: 3067 |
| | | AA | SGGYYWS SEQ ID NO: 1183 | YIYYSGSTYYNPSLKS SEQ ID NO: 1340 | DRITIFGVVMGGGMDV SEQ ID NO: 1497 |
| iPS:361218 | 18E3.008 | NA | AGTGGTGGTTACTACTGGAGC SEQ ID NO: 2754 | TACATCTATTACAGTGGGAGCACCTACTACAACCCGTCCCTCAAGAGT SEQ ID NO: 2911 | GATCGTATTACGATTTTTGGAGTGGTTATGGGGGGCGGTATGGACGTC SEQ ID NO: 3068 |
| | | AA | SGGYYWS SEQ ID NO: 1184 | YIYYSGSTYYNPSLKS SEQ ID NO: 1341 | DRITIFGVVMGGGMDV SEQ ID NO: 1498 |
| iPS:361222 | 5C2.006 | NA | GGCTACTATATCCAC SEQ ID NO: 2755 | TGGATCAACCCTGAAAGTGGTGGCACAGACTATTCACAGAGGTTTCAGGGC SEQ ID NO: 2912 | GAGGCCACGATTTTTGGAATGGTTATTGTACCGTTTGACTAC SEQ ID NO: 3069 |
| | | AA | GYYIH SEQ ID NO: 1185 | WINPESGGTDYSQRFQG SEQ ID NO: 1342 | EATIFGMVIVPFDY SEQ ID NO: 1499 |
| iPS:361229 | 5C2.007 | NA | GGCTACTATATCCAC SEQ ID NO: 2756 | TGGATCAACCCTGAAAGTGGTGGCACAGACTATTCACAGAGGTTTCAGGGC SEQ ID NO: 2913 | GAGGCCACGATTTTTGGAATGGTTATTGTACCGTTTGACTAC SEQ ID NO: 3070 |
| | | AA | GYYIH SEQ ID NO: 1186 | WINPESGGTDYSQRFQG SEQ ID NO: 1343 | EATIFGMVIVPFDY SEQ ID NO: 1500 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| iPS:361236 | 5C2.008 | NA | GGCTACTATATCCAC SEQ ID NO: 2757 | TGGATCAACCCTGACGCTGGTG GCACAGACTATTCACAGAGGTT TCAGGGC SEQ ID NO: 2914 | GAGGCCACGATTTTTGGAATGG TTATTGTACCGTTTGACTAC SEQ ID NO: 3071 |
| | | AA | GYYIH SEQ ID NO: 1187 | WINPDAGGTDYSQRFQG SEQ ID NO: 1344 | EATIFGMVIVPFDY SEQ ID NO: 1501 |
| iPS:359685 | 5C2.009 | NA | GGCTACTATATCCAC SEQ ID NO: 2758 | TGGATCAACCCTGACGCTGGTG GCACAGACTATTCACAGAGGTT TCAGGGC SEQ ID NO: 2915 | GAGGCCACGATTTTTGGAATGG TTATTGTACCGTTTGACTAC SEQ ID NO: 3072 |
| | | AA | GYYIH SEQ ID NO: 1188 | WINPDAGGTDYSQRFQG SEQ ID NO: 1345 | EATIFGMVIVPFDY SEQ ID NO: 1502 |
| iPS:361240 | 5C2.010 | NA | GGCTACTATATCCAC SEQ ID NO: 2759 | TGGATCAACCCTGACAGTGGTG GCACAGACTATTCACAGAGGTT TCAGGGC SEQ ID NO: 2916 | GAGGCCACGATTTTTGGAATGG TTATTGTACCGTTTGACTAC SEQ ID NO: 3073 |
| | | AA | GYYIH SEQ ID NO: 1189 | WINPDSGGTDYSQRFQG SEQ ID NO: 1346 | EATIFGMVIVPFDY SEQ ID NO: 1503 |
| iPS:361247 | 5C2.011 | NA | GGCTACTATATCCAC SEQ ID NO: 2760 | TGGATCAACCCTGACAGTGGTG GCACAGACTATTCACAGAGGTT TCAGGGC SEQ ID NO: 2917 | GAGGCCACGATTTTTGGAATGG TTATTGTACCGTTTGACTAC SEQ ID NO: 3074 |
| | | AA | GYYIH SEQ ID NO: 1190 | WINPDSGGTDYSQRFQG SEQ ID NO: 1347 | EATIFGMVIVPFDY SEQ ID NO: 1504 |
| iPS:361254 | 5C2.012 | NA | GGCTACTATATCCAC SEQ ID NO: 2761 | TGGATCAACCCTGACAGTGGTG GCACAGACTATTCACAGAGGTT TCAGGGC SEQ ID NO: 2918 | GAGGCCACGATTTTTGGAATGG TTATTGTACCGTTTGACTAC SEQ ID NO: 3075 |
| | | AA | GYYIH SEQ ID NO: 1191 | WINPDSGGTDYSQRFQG SEQ ID NO: 1348 | EATIFGMVIVPFDY SEQ ID NO: 1505 |
| iPS:361261 | 5C2.013 | NA | GGCTACTATATCCAC SEQ ID NO: 2762 | TGGATCAACCCTGACGCTGGTG GCACAGACTATTCACAGAGGTT TCAGGGC SEQ ID NO: 2919 | GAGGCCACGATTTTTGGAATGG TTATTGTACCGTTTGACTAC SEQ ID NO: 3076 |
| | | AA | GYYIH SEQ ID NO: 1192 | WINPDAGGTDYSQRFQG SEQ ID NO: 1349 | EATIFGMVIVPFDY SEQ ID NO: 1506 |
| iPS:361268 | 5C2.014 | NA | GGCTACTATATCCAC SEQ ID NO: 2763 | TGGATCAACCCTGACGCTGGTG GCACAGACTATTCACAGAGGTT TCAGGGC SEQ ID NO: 2920 | GAGGCCACGATTTTTGGAATGG TTATTGTACCGTTTGACTAC SEQ ID NO: 3077 |
| | | AA | GYYIH SEQ ID NO: 1193 | WINPDAGGTDYSQRFQG SEQ ID NO: 1350 | EATIFGMVIVPFDY SEQ ID NO: 1507 |
| iPS:359669 | 5C2.015 | NA | GGCTACTATATCCAC SEQ ID NO: 2764 | TGGATCAACCCTGACGCTGGTG GCACAGACTATTCACAGAGGTT TCAGGGC SEQ ID NO: 2921 | GAGGCCACGATTTTTGGAATGG TTATTGTACCGTTTGACTAC SEQ ID NO: 3078 |
| | | AA | GYYIH SEQ ID NO: 1194 | WINPDAGGTDYSQRFQG SEQ ID NO: 1351 | EATIFGMVIVPFDY SEQ ID NO: 1508 |
| iPS:359678 | 5C2.016 | NA | GGCTACTATATCCAC SEQ ID NO: 2765 | TGGATCAACCCTGAAAGTGGTG GCACAGACTATTCACAGAGGTT TCAGGGC SEQ ID NO: 2922 | GAGGCCACGATTTTTGGAATGG TTATTGTACCGTTTGACTAC SEQ ID NO: 3079 |
| | | AA | GYYIH SEQ ID NO: 1195 | WINPESGGTDYSQRFQG SEQ ID NO: 1352 | EATIFGMVIVPFDY SEQ ID NO: 1509 |
| iPS:361275 | 11C1.002 | NA | GGCTACTATATACAC SEQ ID NO: 2766 | TGGATCAGCCCTAACAGTGGTG AAACAAGCTATGCACAGAAGT TTCAGGAC SEQ ID NO: 2923 | GAGGCCACGATTTTTGGAATGC TTATTGTACCATTTGACTAC SEQ ID NO: 3080 |

TABLE 4B-continued

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| | | AA | GYYIH SEQ ID NO: 1196 | WISPNSGETSYAQKFQD SEQ ID NO: 1353 | EATIFGMLIVPFDY SEQ ID NO: 1510 |
| iPS:361282 | 11C1.003 | NA | GGCTACTATATACAC SEQ ID NO: 2767 | TGGATCAGCCCTAACAGTGGTG ACACAAGCTATGCACAGAAGT TTCAGGAC SEQ ID NO: 2924 | GAGGCCACGATTTTTGGAATGC TTATTGTACCATTTGACTAC SEQ ID NO: 3081 |
| | | AA | GYYIH SEQ ID NO: 1197 | WISPNSGDTSYAQKFQD SEQ ID NO: 1354 | EATIFGMLIVPFDY SEQ ID NO: 1511 |
| iPS:361289 | 11C1.004 | NA | GGCTACTATATACAC SEQ ID NO: 2768 | TGGATCAGCCCTAACAGTGGTG AAACAAGCTATGCACAGAAGT TTCAGGAC SEQ ID NO: 2925 | GAGGCCACGATTTTTGGAATGC TTATTGTACCATTTGACTAC SEQ ID NO: 3082 |
| | | AA | GYYIH SEQ ID NO: 1198 | WISPNSGETSYAQKFQD SEQ ID NO: 1355 | EATIFGMLIVPFDY SEQ ID NO: 1512 |
| iPS:359712 | 11C1.005 | NA | GGCTACTATATACAC SEQ ID NO: 2769 | TGGATCAGCCCTAACAGTGGTG AAACAAGCTATGCACAGAAGT TTCAGGAC SEQ ID NO: 2926 | GAGGCCACGATTTTTGGAATGC TTATTGTACCATTTGACTAC SEQ ID NO: 3083 |
| | | AA | GYYIH SEQ ID NO: 1199 | WISPNSGETSYAQKFQD SEQ ID NO: 1356 | EATIFGMLIVPFDY SEQ ID NO: 1513 |
| iPS:361293 | 11C1.006 | NA | GGCTACTATATACAC SEQ ID NO: 2770 | TGGATCAGCCCTAACAGTGGTG ACACAAGCTATGCACAGAAGT TTCAGGAC SEQ ID NO: 2927 | GAGGCCACGATTTTTGGAATGC TTATTGTACCATTTGACTAC SEQ ID NO: 3084 |
| | | AA | GYYIH SEQ ID NO: 1200 | WISPNSGDTSYAQKFQD SEQ ID NO: 1357 | EATIFGMLIVPFDY SEQ ID NO: 1514 |
| iPS:361297 | 11C1.007 | NA | GGCTACTATATACAC SEQ ID NO: 2771 | TGGATCAGCCCTAACAGTGGTG AAACAAGCTATGCACAGAAGT TTCAGGAC SEQ ID NO: 2928 | GAGGCCACGATTTTTGGAATGC TTATTGTACCATTTGACTAC SEQ ID NO: 3085 |
| | | AA | GYYIH SEQ ID NO: 1201 | WISPNSGETSYAQKFQD SEQ ID NO: 1358 | EATIFGMLIVPFDY SEQ ID NO: 1515 |
| iPS:361301 | 11C1.008 | NA | GGCTACTATATACAC SEQ ID NO: 2772 | TGGATCAGCCCTAACAGTGGTG ACACAAGCTATGCACAGAAGT TTCAGGAC SEQ ID NO: 2929 | GAGGCCACGATTTTTGGAATGC TTATTGTACCATTTGACTAC SEQ ID NO: 3086 |
| | | AA | GYYIH SEQ ID NO: 1202 | WISPNSGDTSYAQKFQD SEQ ID NO: 1359 | EATIFGMLIVPFDY SEQ ID NO: 1516 |
| iPS:359703 | 11C1.009 | NA | GGCTACTATATACAC SEQ ID NO: 2773 | TGGATCAGCCCTAACAGTGGTG AAACAAGCTATGCACAGAAGT TTCAGGAC SEQ ID NO: 2930 | GAGGCCACGATTTTTGGAATGC TTATTGTACCATTTGACTAC SEQ ID NO: 3087 |
| | | AA | GYYIH SEQ ID NO: 1203 | WISPNSGETSYAQKFQD SEQ ID NO: 1360 | EATIFGMLIVPFDY SEQ ID NO: 1517 |
| iPS:361305 | 11C1.010 | NA | GGCTACTATATACAC SEQ ID NO: 2774 | TGGATCAGCCCTAACAGTGGTG AAACAAGCTATGCACAGAAGT TTCAGGAC SEQ ID NO: 2931 | GAGGCCACGATTTTTGGAATGC TTATTGTACCATTTGACTAC SEQ ID NO: 3088 |
| | | AA | GYYIH SEQ ID NO: 1204 | WISPNSGETSYAQKFQD SEQ ID NO: 1361 | EATIFGMLIVPFDY SEQ ID NO: 1518 |
| iPS:361312 | 13H12.002 | NA | GGCTACTATATCCAC SEQ ID NO: 2775 | TGGATCAACCCTGAAAGTGGTG GCACAGACTATTCACAGAGGTT TCAGGGC SEQ ID NO: 2932 | GAGGCCACGATTTTTGGAATGG TTATTGTACCGTTTGACTAC SEQ ID NO: 3089 |
| | | AA | GYYIH SEQ ID NO: 1205 | WINPESGGTDYSQRFQG SEQ ID NO: 1362 | EATIFGMVIVPFDY SEQ ID NO: 1519 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| iPS:359744 | 13H12.003 | NA | GGCTACTATATCCAC<br>SEQ ID NO: 2776 | TGGATCAACCCTGAAAGTGGTG<br>GCACAGACTATTCACAGAGGTT<br>TCAGGGC<br>SEQ ID NO: 2933 | GAGGCCACGATTTTTGGAATGG<br>TTATTGTACCGTTTGACTAC<br>SEQ ID NO: 3090 |
| | | AA | GYYIH<br>SEQ ID NO: 1206 | WINPESGGTDYSQRFQG<br>SEQ ID NO: 1363 | EATIFGMVIVPFDY<br>SEQ ID NO: 1520 |
| iPS:361319 | 13H12.004 | NA | GGCTACTATATCCAC<br>SEQ ID NO: 2777 | TGGATCAACCCTGACAGTGGTG<br>GCACAGACTATTCACAGAGGTT<br>TCAGGGC<br>SEQ ID NO: 2934 | GAGGCCACGATTTTTGGAATGG<br>TTATTGTACCGTTTGACTAC<br>SEQ ID NO: 3091 |
| | | AA | GYYIH<br>SEQ ID NO: 1207 | WINPDSGGTDYSQRFQG<br>SEQ ID NO: 1364 | EATIFGMVIVPFDY<br>SEQ ID NO: 1521 |
| iPS:359737 | 13H12.005 | NA | GGCTACTATATCCAC<br>SEQ ID NO: 2778 | TGGATCAACCCTGAAAGTGGTG<br>GCACAGACTATTCACAGAGGTT<br>TCAGGGC<br>SEQ ID NO: 2935 | GAGGCCACGATTTTTGGAATGG<br>TTATTGTACCGTTTGACTAC<br>SEQ ID NO: 3092 |
| | | AA | GYYIH<br>SEQ ID NO: 1208 | WINPESGGTDYSQRFQG<br>SEQ ID NO: 1365 | EATIFGMVIVPFDY<br>SEQ ID NO: 1522 |
| iPS:361326 | 13H12.006 | NA | GGCTACTATATCCAC<br>SEQ ID NO: 2779 | TGGATCAACCCTGAAAGTGGTG<br>GCACAGACTATTCACAGAGGTT<br>TCAGGGC<br>SEQ ID NO: 2936 | GAGGCCACGATTTTTGGAATGG<br>TTATTGTACCGTTTGACTAC<br>SEQ ID NO: 3093 |
| | | AA | GYYIH<br>SEQ ID NO: 1209 | WINPESGGTDYSQRFQG<br>SEQ ID NO: 1366 | EATIFGMVIVPFDY<br>SEQ ID NO: 1523 |
| iPS:361330 | 12H11.002 | NA | GGCTACTATATACAC<br>SEQ ID NO: 2780 | TGGATAAGCCCTAACCAAGGT<br>GAAACAAACTATGCACAGAAG<br>TTTCAGGAC<br>SEQ ID NO: 2937 | GAGGCCACGATTTTTGGAATGC<br>TTATTGTACCATTTGACTAC<br>SEQ ID NO: 3094 |
| | | AA | GYYIH<br>SEQ ID NO: 1210 | WISPNQGETNYAQKFQD<br>SEQ ID NO: 1367 | EATIFGMLIVPFDY<br>SEQ ID NO: 1524 |
| iPS:361337 | 12H11.003 | NA | GGCTACTATATACAC<br>SEQ ID NO: 2781 | TGGATAAGCCCTAACCAAGGT<br>GACACAAACTATGCACAGAAG<br>TTTCAGGAC<br>SEQ ID NO: 2938 | GAGGCCACGATTTTTGGAATGC<br>TTATTGTACCATTTGACTAC<br>SEQ ID NO: 3095 |
| | | AA | GYYIH<br>SEQ ID NO: 1211 | WISPNQGDTNYAQKFQD<br>SEQ ID NO: 1368 | EATIFGMLIVPFDY<br>SEQ ID NO: 1525 |
| iPS:361344 | 12H11.004 | NA | GGCTACTATATACAC<br>SEQ ID NO: 2782 | TGGATAAGCCCTAACCAAGGT<br>GAAACAAACTATGCACAGAAG<br>TTTCAGGAC<br>SEQ ID NO: 2939 | GAGGCCACGATTTTTGGAATGC<br>TTATTGTACCATTTGACTAC<br>SEQ ID NO: 3096 |
| | | AA | GYYIH<br>SEQ ID NO: 1212 | WISPNQGETNYAQKFQD<br>SEQ ID NO: 1369 | EATIFGMLIVPFDY<br>SEQ ID NO: 1526 |
| iPS:361351 | 12H11.005 | NA | GGCTACTATATACAC<br>SEQ ID NO: 2783 | TGGATAAGCCCTAACAATGGTG<br>AAACAAACTATGCACAGAAGT<br>TTCAGGAC<br>SEQ ID NO: 2940 | GAGGCCACGATTTTTGGAATGC<br>TTATTGTACCATTTGACTAC<br>SEQ ID NO: 3097 |
| | | AA | GYYIH<br>SEQ ID NO: 1213 | WISPNNGETNYAQKFQD<br>SEQ ID NO: 1370 | EATIFGMLIVPFDY<br>SEQ ID NO: 1527 |
| iPS:361358 | 12H11.006 | NA | GGCTACTATATACAC<br>SEQ ID NO: 2784 | TGGATAAGCCCTAACAATGGTG<br>ACACAAACTATGCACAGAAGT<br>TTCAGGAC<br>SEQ ID NO: 2941 | GAGGCCACGATTTTTGGAATGC<br>TTATTGTACCATTTGACTAC<br>SEQ ID NO: 3098 |
| | | AA | GYYIH<br>SEQ ID NO: 1214 | WISPNNGDTNYAQKFQD<br>SEQ ID NO: 1371 | EATIFGMLIVPFDY<br>SEQ ID NO: 1528 |
| iPS:361365 | 12H11.007 | NA | GGCTACTATATACAC<br>SEQ ID NO: 2785 | TGGATAAGCCCTAACCAAGGT<br>GACACAAACTATGCACAGAAG<br>TTTCAGGAC<br>SEQ ID NO: 2942 | GAGGCCACGATTTTTGGAATGC<br>TTATTGTACCATTTGACTAC<br>SEQ ID NO: 3099 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | GYYIH<br>SEQ ID NO: 1215 | WISPNQGDTNYAQKFQD<br>SEQ ID NO: 1372 | EATIFGMLIVPFDY<br>SEQ ID NO: 1529 |
| iPS:361372 | 12H11.008 | NA | GGCTACTATATACAC<br>SEQ ID NO: 2786 | TGGATAAGCCCTAACAATGGTG<br>AAACAAACTATGCACAGAAGT<br>TTCAGGAC<br>SEQ ID NO: 2943 | GAGGCCACGATTTTTGGAATGC<br>TTATTGTACCATTTGACTAC<br>SEQ ID NO: 3100 |
| | | AA | GYYIH<br>SEQ ID NO: 1216 | WISPNNGETNYAQKFQD<br>SEQ ID NO: 1373 | EATIFGMLIVPFDY<br>SEQ ID NO: 1530 |
| iPS:361379 | 12H11.009 | NA | GGCTACTATATACAC<br>SEQ ID NO: 2787 | TGGATAAGCCCTAACCAAGGT<br>GAAACAAACTATGCACAGAAG<br>TTTCAGGAC<br>SEQ ID NO: 2944 | GAGGCCACGATTTTTGGAATGC<br>TTATTGTACCATTTGACTAC<br>SEQ ID NO: 3101 |
| | | AA | GYYIH<br>SEQ ID NO: 1217 | WISPNQGETNYAQKFQD<br>SEQ ID NO: 1374 | EATIFGMLIVPFDY<br>SEQ ID NO: 1531 |
| iPS:361383 | 12H11.010 | NA | GGCTACTATATACAC<br>SEQ ID NO: 2788 | TGGATAAGCCCTAACAATGGTG<br>ACACAAACTATGCACAGAAGT<br>TTCAGGAC<br>SEQ ID NO: 2945 | GAGGCCACGATTTTTGGAATGC<br>TTATTGTACCATTTGACTAC<br>SEQ ID NO: 3102 |
| | | AA | GYYIH<br>SEQ ID NO: 1218 | WISPNNGDTNYAQKFQD<br>SEQ ID NO: 1375 | EATIFGMLIVPFDY<br>SEQ ID NO: 1532 |
| iPS:361387 | 12H11.011 | NA | GGCTACTATATACAC<br>SEQ ID NO: 2789 | TGGATAAGCCCTAACCAAGGT<br>GACACAAACTATGCACAGAAG<br>TTTCAGGAC<br>SEQ ID NO: 2946 | GAGGCCACGATTTTTGGAATGC<br>TTATTGTACCATTTGACTAC<br>SEQ ID NO: 3103 |
| | | AA | GYYIH<br>SEQ ID NO: 1219 | WISPNQGDTNYAQKFQD<br>SEQ ID NO: 1376 | EATIFGMLIVPFDY<br>SEQ ID NO: 1533 |
| iPS:361391 | 12H11.012 | NA | GGCTACTATATACAC<br>SEQ ID NO: 2790 | TGGATAAGCCCTAACAATGGTG<br>AAACAAACTATGCACAGAAGT<br>TTCAGGAC<br>SEQ ID NO: 2947 | GAGGCCACGATTTTTGGAATGC<br>TTATTGTACCATTTGACTAC<br>SEQ ID NO: 3104 |
| | | AA | GYYIH<br>SEQ ID NO: 1220 | WISPNNGETNYAQKFQD<br>SEQ ID NO: 1377 | EATIFGMLIVPFDY<br>SEQ ID NO: 1534 |
| iPS:361395 | 12H11.013 | NA | GGCTACTATATACAC<br>SEQ ID NO: 2791 | TGGATAAGCCCTAACCAAGGT<br>GAAACAAACTATGCACAGAAG<br>TTTCAGGAC<br>SEQ ID NO: 2948 | GAGGCCACGATTTTTGGAATGC<br>TTATTGTACCATTTGACTAC<br>SEQ ID NO: 3105 |
| | | AA | GYYIH<br>SEQ ID NO: 1221 | WISPNQGETNYAQKFQD<br>SEQ ID NO: 1378 | EATIFGMLIVPFDY<br>SEQ ID NO: 1535 |
| iPS:361402 | 12H11.014 | NA | GGCTACTATATACAC<br>SEQ ID NO: 2792 | TGGATAAGCCCTAACCAAGGT<br>GAAACAAACTATGCACAGAAG<br>TTTCAGGAC<br>SEQ ID NO: 2949 | GAGGCCACGATTTTTGGAATGC<br>TTATTGTACCATTTGACTAC<br>SEQ ID NO: 3106 |
| | | AA | GYYIH<br>SEQ ID NO: 1222 | WISPNQGETNYAQKFQD<br>SEQ ID NO: 1379 | EATIFGMLIVPFDY<br>SEQ ID NO: 1536 |
| iPS:361406 | 2C2.005.001 | NA | GGCTACTATATGCAT<br>SEQ ID NO: 2793 | TGGATCAACCCTAACAGTGGTG<br>GCACAAACTATGCACAGAAGT<br>TTCAGGGC<br>SEQ ID NO: 2950 | GGGGGGGATTACGTTTGGGGG<br>ACTTATCGGCCTCACTACTACT<br>ACGGTATGGACGTC<br>SEQ ID NO: 3107 |
| | | AA | GYYMH<br>SEQ ID NO: 1223 | WINPNSGGTNYAQKFQG<br>SEQ ID NO: 1380 | GGDYVWGTYRPHYYYGMDV<br>SEQ ID NO: 1537 |
| iPS:361412 | 2C2.005.002 | NA | GGCTACTATATGCAT<br>SEQ ID NO: 2794 | TGGATCAACCCTAACAGTGGTG<br>GCACAAACTATGCACAGAAGT<br>TTCAGGGC<br>SEQ ID NO: 2951 | GGGGGGGATTACGTTTGGGGG<br>ACTTATCGGCCTCACTACTACT<br>ACGGTATGGACGTC<br>SEQ ID NO: 3108 |
| | | AA | GYYMH<br>SEQ ID NO: 1224 | WINPNSGGTNYAQKFQG<br>SEQ ID NO: 1381 | GGDYVWGTYRPHYYYGMDV<br>SEQ ID NO: 1538 |

TABLE 4B-continued

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| iPS:361418 | 2C2.005.003 | NA | GGCTACTATATGCAT SEQ ID NO: 2795 | TGGATCAACCCTAACAGTGGTG GCACAAACTATGCACAGAAGT TTCAGGGC SEQ ID NO: 2952 | GGGGGGGATTACGTTTGGGGG ACTTATCGGCCTCACTACTACT ACGGTATGGACGTC SEQ ID NO: 3109 |
| | | AA | GYYMH SEQ ID NO: 1225 | WINPNSGGTNYAQKFQG SEQ ID NO: 1382 | GGDYVWGTYRPHYYYGMDV SEQ ID NO: 1539 |
| iPS:361424 | 2C2.005.004 | NA | GGCTACTATATGCAT SEQ ID NO: 2796 | TGGATCAACCCTAACAGTGGTG GCACAAACTATGCACAGAAGT TTCAGGGC SEQ ID NO: 2953 | GGGGGGGATTACGTTTGGGGG ACTTATCGGCCTCACTACTACT ACGGTATGGACGTC SEQ ID NO: 3110 |
| | | AA | GYYMH SEQ ID NO: 1226 | WINPNSGGTNYAQKFQG SEQ ID NO: 1383 | GGDYVWGTYRPHYYYGMDV SEQ ID NO: 1540 |
| iPS:361430 | 2C2.005.005 | NA | GGCTACTATATGCAT SEQ ID NO: 2797 | TGGATCAACCCTAACAGTGGTG GCACAAACTATGCACAGAAGT TTCAGGGC SEQ ID NO: 2954 | GGGGGGGATTACGTTTGGGGG ACTTATCGGCCTCACTACTACT ACGGTATGGACGTC SEQ ID NO: 3111 |
| | | AA | GYYMH SEQ ID NO: 1227 | WINPNSGGTNYAQKFQG SEQ ID NO: 1384 | GGDYVWGTYRPHYYYGMDV SEQ ID NO: 1541 |
| iPS:361436 | 2C2.005.006 | NA | GGCTACTATATGCAT SEQ ID NO: 2798 | TGGATCAACCCTAACAGTGGTG GCACAAACTATGCACAGAAGT TTCAGGGC SEQ ID NO: 2955 | GGGGGGGATTACGTTTGGGGG ACTTATCGGCCTCACTACTACT ACGGTATGGACGTC SEQ ID NO: 3112 |
| | | AA | GYYMH SEQ ID NO: 1228 | WINPNSGGTNYAQKFQG SEQ ID NO: 1385 | GGDYVWGTYRPHYYYGMDV SEQ ID NO: 1542 |
| iPS:361442 | 2C2.005.007 | NA | GGCTACTATATGCAT SEQ ID NO: 2799 | TGGATCAACCCTAACAGTGGTG GCACAAACTATGCACAGAAGT TTCAGGGC SEQ ID NO: 2956 | GGGGGGGATTACGTTTGGGGG ACTTATCGGCCTCACTACTACT ACGGTATGGACGTC SEQ ID NO: 3113 |
| | | AA | GYYMH SEQ ID NO: 1229 | WINPNSGGTNYAQKFQG SEQ ID NO: 1386 | GGDYVWGTYRPHYYYGMDV SEQ ID NO: 1543 |
| iPS:361448 | 2C2.005.008 | NA | GGCTACTATATGCAT SEQ ID NO: 2800 | TGGATCAACCCTAACAGTGGTG GCACAAACTATGCACAGAAGT TTCAGGGC SEQ ID NO: 2957 | GGGGGGGATTACGTTTGGGGG ACTTATCGGCCTCACTACTACT ACGGTATGGACGTC SEQ ID NO: 3114 |
| | | AA | GYYMH SEQ ID NO: 1230 | WINPNSGGTNYAQKFQG SEQ ID NO: 1387 | GGDYVWGTYRPHYYYGMDV SEQ ID NO: 1544 |
| iPS:361454 | 2C2.005.009 | NA | GGCTACTATATGCAT SEQ ID NO: 2801 | TGGATCAACCCTAACAGTGGTG GCACAAACTATGCACAGAAGT TTCAGGGC SEQ ID NO: 2958 | GGGGGGGATTACGTTTGGGGG ACTTATCGGCCTCACTACTACT ACGGTATGGACGTC SEQ ID NO: 3115 |
| | | AA | GYYMH SEQ ID NO: 1231 | WINPNSGGTNYAQKFQG SEQ ID NO: 1388 | GGDYVWGTYRPHYYYGMDV SEQ ID NO: 1545 |
| iPS:361460 | 2C2.005.010 | NA | GGCTACTATATGCAT SEQ ID NO: 2802 | TGGATCAACCCTAACAGTGGTG GCACAAACTATGCACAGAAGT TTCAGGGC SEQ ID NO: 2959 | GGGGGGGATTACGTTTGGGGG ACTTATCGGCCTCACTACTACT ACGGTATGGACGTC SEQ ID NO: 3116 |
| | | AA | GYYMH SEQ ID NO: 1232 | WINPNSGGTNYAQKFQG SEQ ID NO: 1389 | GGDYVWGTYRPHYYYGMDV SEQ ID NO: 1546 |
| iPS:361466 | 2C2.005.011 | NA | GGCTACTATATGCAT SEQ ID NO: 2803 | TGGATCAACCCTAACAGTGGTG GCACAAACTATGCACAGAAGT TTCAGGGC SEQ ID NO: 2960 | GGGGGGGATTACGTTTGGGGG ACTTATCGGCCTCACTACTACT ACGGTATGGACGTC SEQ ID NO: 3117 |
| | | AA | GYYMH SEQ ID NO: 1233 | WINPNSGGTNYAQKFQG SEQ ID NO: 1390 | GGDYVWGTYRPHYYYGMDV SEQ ID NO: 1547 |
| iPS:361472 | 2C2.005.012 | NA | GGCTACTATATGCAT SEQ ID NO: 2804 | TGGATCAACCCTAACAGTGGTG GCACAAACTATGCACAGAAGT TTCAGGGC SEQ ID NO: 2961 | GGGGGGGATTACGTTTGGGGG ACTTATCGGCCTCACTACTACT ACGGTATGGACGTC SEQ ID NO: 3118 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | GYYMH<br>SEQ ID NO: 1234 | WINPNSGGTNYAQKFQG<br>SEQ ID NO: 1391 | GGDYVWGTYRPHYYYGMDV<br>SEQ ID NO: 1548 |
| iPS:361478 | 2C2.005.013 | NA | GGCTACTATATGCAT<br>SEQ ID NO: 2805 | TGGATCAACCCTAACAGTGGTG<br>GCACAAACTATGCACAGAAGT<br>TTCAGGGC<br>SEQ ID NO: 2962 | GGGGGGGATTACGTTTTCGGGA<br>CTTATCGGCCTCACTACTACTA<br>CGGTATGGACGTC<br>SEQ ID NO: 3119 |
| | | AA | GYYMH<br>SEQ ID NO: 1235 | WINPNSGGTNYAQKFQG<br>SEQ ID NO: 1392 | GGDYVFGTYRPHYYYGMDV<br>SEQ ID NO: 1549 |
| iPS:361485 | 2C2.005.014 | NA | GGCTACTATATGCAT<br>SEQ ID NO: 2806 | TGGATCAACCCTAACAGTGGTG<br>GCACAAACTATGCACAGAAGT<br>TTCAGGGC<br>SEQ ID NO: 2963 | GGGGGGGATTACGTTTTCGGGA<br>CTTATCGGCCTCACTACTACTA<br>CGGTATGGACGTC<br>SEQ ID NO: 3120 |
| | | AA | GYYMH<br>SEQ ID NO: 1236 | WINPNSGGTNYAQKFQG<br>SEQ ID NO: 1393 | GGDYVFGTYRPHYYYGMDV<br>SEQ ID NO: 1550 |
| iPS:361845 | 18F2.013 | NA | AACTTTGGCATGCAC<br>SEQ ID NO: 2807 | GTTATATGGTATGATGCAAGTA<br>ATGAAAACTATGCAGACGCCG<br>TGAAGGGC<br>SEQ ID NO: 2964 | GATAGGACGATCTTTGGAGTGG<br>TCTTGGGGGACTAC<br>SEQ ID NO: 3121 |
| | | AA | NFGMH<br>SEQ ID NO: 1237 | VIWYDASNENYADAVKG<br>SEQ ID NO: 1394 | DRTIFGVVLGDY<br>SEQ ID NO: 1551 |
| iPS:361851 | 6H1.009 | NA | TACTTTGGCATGCAC<br>SEQ ID NO: 2808 | GTTATATGGTATGATGCAAGTA<br>ATAAATACTATGCAGACGCCGT<br>GAAGGGC<br>SEQ ID NO: 2965 | GATAGGACGATTTTTGGAGTGC<br>TCTTGGGGGACTAC<br>SEQ ID NO: 3122 |
| | | AA | YFGMH<br>SEQ ID NO: 1238 | VIWYDASNKYYADAVKG<br>SEQ ID NO: 1395 | DRTIFGVLLGDY<br>SEQ ID NO: 1552 |
| iPS:361855 | 2C2.005.015 | NA | GGCTACTATATGCAT<br>SEQ ID NO: 2809 | TGGATCAACCCTAACAGTGGTG<br>GCACAAACTATGCACAGAAGT<br>TTCAGGGC<br>SEQ ID NO: 2966 | GGGGGGGATTACGTTTGGGGG<br>ACTTATCGGCCTCACTACTACT<br>ACGGTATGGACGTC<br>SEQ ID NO: 3123 |
| | | AA | GYYMH<br>SEQ ID NO: 1239 | WINPNSGGTNYAQKFQG<br>SEQ ID NO: 1396 | GGDYVWGTYRPHYYYGMDV<br>SEQ ID NO: 1553 |
| iPS:336067 | 5G12.006 | NA | AGCTATGGCATACAC<br>SEQ ID NO: 2810 | GTTATATGGTATGATGGAAGTA<br>ATAAGTTCCATGCAGACTCCGT<br>GAAGGGC<br>SEQ ID NO: 2967 | GGAAAAGTGGCTGGTATGCCT<br>GAAGCTTTTGAAATC<br>SEQ ID NO: 3124 |
| | | AA | SYGIH<br>SEQ ID NO: 1240 | VIWYDGSNKFHADSVKG<br>SEQ ID NO: 1397 | GKVAGMPEAFEI<br>SEQ ID NO: 1554 |
| iPS:336169 | 17B11.002 | NA | AGTTATGATATCAAC<br>SEQ ID NO: 2811 | TGGATGAACCCTAACAGTGGTA<br>ACACAGGCTATGCACAGAAGT<br>TCCAGGGC<br>SEQ ID NO: 2968 | GGGGGTGATTACGTTTGGGGG<br>AGTTATCGTCCCTACTACTACT<br>ACTACGGTATGGACGTC<br>SEQ ID NO: 3125 |
| | | AA | SYDIN<br>SEQ ID NO: 1241 | WMNPNSGNTGYAQKFQG<br>SEQ ID NO: 1398 | GGDYVWGSYRPYYYYYGMDV<br>SEQ ID NO: 1555 |
| iPS:361127 | 5G12.006.001 | NA | AGCTATGGCATACAC<br>SEQ ID NO: 2812 | GTTATATGGTATGATGCAAGTA<br>ATAAGTTCCATGCAGACGCCGT<br>GAAGGGC<br>SEQ ID NO: 2969 | GGAAAAGTGGCTGGTATGCCT<br>GAAGCTTTTGAAATC<br>SEQ ID NO: 3126 |
| | | AA | SYGIH<br>SEQ ID NO: 1242 | VIWYDASNKFHADAVKG<br>SEQ ID NO: 1399 | GKVAGMPEAFEI<br>SEQ ID NO: 1556 |
| iPS:361136 | 5G12.006.002 | NA | AGCTATGGCATACAC<br>SEQ ID NO: 2813 | GTTATATGGTATGATGCAAGTA<br>ATAAGTTCCATGCAGACGCCGT<br>GAAGGGC<br>SEQ ID NO: 2970 | GGAAAAGTGGCTGGTATGCCT<br>GAAGCTTTTGAAATC<br>SEQ ID NO: 3127 |
| | | AA | SYGIH<br>SEQ ID NO: 1243 | VIWYDASNKFHADAVKG<br>SEQ ID NO: 1400 | GKVAGMPEAFEI<br>SEQ ID NO: 1557 |

TABLE 4B-continued

| Exemplary CDRH1, CDRH2, and CDRH3 Nucleotide and Amino Acid Sequences | | | | | |
|---|---|---|---|---|---|
| iPS# | Ab | Type | CDRH1 | CDRH2 | CDRH3 |
| iPS:361140 | 5G12.006.003 | NA | AGCTATGGCATACAC SEQ ID NO: 2814 | GTTATATGGTATGATGCAAGTA ATAAGTTCCATGCAGACGCCGT GAAGGGC SEQ ID NO: 2971 | GGAAAAGTGGCTGGTATGCCT GAAGCTTTTGAAATC SEQ ID NO: 3128 |
| | | AA | SYGIH SEQ ID NO: 1244 | VIWYDASNKFHADAVKG SEQ ID NO: 1401 | GKVAGMPEAFEI SEQ ID NO: 1558 |
| iPS:359919 | 5G12.006.004 | NA | AGCTATGGCATACAC SEQ ID NO: 2815 | GTTATATGGTATGATGCAAGTA ATAAGTTCCATGCAGACGCCGT GAAGGGC SEQ ID NO: 2972 | GGAAAAGTGGCTGGTATGCCT GAAGCTTTTGAAATC SEQ ID NO: 3129 |
| | | AA | SYGIH SEQ ID NO: 1245 | VIWYDASNKFHADAVKG SEQ ID NO: 1402 | GKVAGMPEAFEI SEQ ID NO: 1559 |
| iPS:361144 | 5G12.006.005 | | AGCTATGGCATACAC SEQ ID NO: 2816 | GTTATATGGTATGATGCAAGTA ATAAGTTCCATGCAGACTCCGT GAAGGGC SEQ ID NO: 2973 | GGAAAAGTGGCTGGTATGCCT GAAGCTTTTGAAATC SEQ ID NO: 3130 |
| | | AA | SYGIH SEQ ID NO: 1246 | VIWYDASNKFHADSVKG SEQ ID NO: 1403 | GKVAGMPEAFEI SEQ ID NO: 1560 |
| iPS:361151 | 5G12.006.006 | NA | AGCTATGGCATACAC SEQ ID NO: 2817 | GTTATATGGTATGATGGAAGTA ATAAGTTCCATGCAGACGCCGT GAAGGGC SEQ ID NO: 2974 | GGAAAAGTGGCTGGTATGCCT GAAGCTTTTGAAATC SEQ ID NO: 3131 |
| | | AA | SYGIH SEQ ID NO: 1247 | VIWYDGSNKFHADAVKG SEQ ID NO: 1404 | GKVAGMPEAFEI SEQ ID NO: 1561 |
| iPS:361491 | 17B11.002.001 | NA | AGTTATGATATCAAC SEQ ID NO: 2818 | TGGATGAACCCTAACAGTGGTG GCACAGGCTATGCACAGAAGT TCCAGGGC SEQ ID NO: 2975 | GGGGGTGATTACGTTTGGGGG AGTTATCGTCCCTACTACTACT ACTACGGTATGGACGTC SEQ ID NO: 3132 |
| | | AA | SYDIN SEQ ID NO: 1248 | WMNPNSGGTGYAQKFQG SEQ ID NO: 1405 | GGDYVWGSYRPYYYYYGMDV SEQ ID NO: 1562 |
| iPS:361499 | 17B11.002.002 | NA | AGTTATGATATCAAC SEQ ID NO: 2819 | TGGATGAACCCTAACAGTGGTA ACACAGGCTATGCACAGAAGT TCCAGGGC SEQ ID NO: 2976 | GGGGGTGATTACGTTTGGGGG AGTTATCGTCCCTACTACTACT ACTACGGTATGGACGTC SEQ ID NO: 3133 |
| | | AA | SYDIN SEQ ID NO: 1249 | WMNPNSGNTGYAQKFQG SEQ ID NO: 1406 | GGDYVWGSYRPYYYYYGMDV SEQ ID NO: 1563 |
| iPS:361503 | 17B11.002.003 | NA | AGTTATGATATCAAC SEQ ID NO: 2820 | TGGATGAACCCTAACAGTGGTG GCACAGGCTATGCACAGAAGT TCCAGGGC SEQ ID NO: 2977 | GGGGGTGATTACGTTTGGGGG AGTTATCGTCCCTACTACTACT ACTACGGTATGGACGTC SEQ ID NO: 3134 |
| | | AA | SYDIN SEQ ID NO: 1250 | WMNPNSGGTGYAQKFQG SEQ ID NO: 1407 | GGDYVWGSYRPYYYYYGMDV SEQ ID NO: 1564 |
| iPS:361507 | 17B11.002.004 | NA | AGTTATGATATCAAC SEQ ID NO: 2821 | TGGATGAACCCTAACAGTGGTG GCACAGGCTATGCACAGAAGT TCCAGGGC SEQ ID NO: 2978 | GGGGGTGATTACGTTTGGGGG AGTTATCGTCCCTACTACTACT ACTACGGTATGGACGTC SEQ ID NO: 3135 |
| | | AA | SYDIN SEQ ID NO: 1251 | WMNPNSGGTGYAQKFQG SEQ ID NO: 1408 | GGDYVWGSYRPYYYYYGMDV SEQ ID NO: 1565 |
| iPS:361514 | 17B11.002.005 | NA | AGTTATGATATCAAC SEQ ID NO: 2822 | TGGATGAACCCTAACAGTGGTG GCACAGGCTATGCACAGAAGT TCCAGGGC SEQ ID NO: 2979 | GGGGGTGATTACGTTTGGGGG AGTTATCGTCCCTACTACTACT ACTACGGTATGGACGTC SEQ ID NO: 3136 |
| | | AA | SYDIN SEQ ID NO: 1252 | WMNPNSGGTGYAQKFQG SEQ ID NO: 1409 | GGDYVWGSYRPYYYYYGMDV SEQ ID NO: 1566 |
| iPS:360582 | 17B11.002.006 | NA | AGTTATGATATCAAC SEQ ID NO: 2823 | TGGATGAACCCTAACAGTGGTA ACACAGGCTATGCACAGAAGT TCCAGGGC SEQ ID NO: 2980 | GGGGGTGATTACGTTTGGGGG AGTTATCGTCCCTACTACTACT ACTACGGTATGGACGTC SEQ ID NO: 3137 |

TABLE 4B-continued

Exemplary CDRH1, CDRH2, and CDRH3 Nucleotide and Amino Acid Sequences

| iPS# | Ab | Type | CDRH1 | CDRH2 | CDRH3 |
|---|---|---|---|---|---|
| | | AA | SYDIN<br>SEQ ID NO: 1253 | WMNPNSGNTGYAQKFQG<br>SEQ ID NO: 1410 | GGDYVWGSYRPYYYYYGMDV<br>SEQ ID NO: 1567 |
| iPS:361518 | 17B11.002.007 | NA | AGTTATGATATCAAC<br>SEQ ID NO: 2824 | TGGATGAACCCTAACAGTGGTG<br>GCACAGGCTATGCACAGAAGT<br>TCCAGGGC<br>SEQ ID NO: 2981 | GGGGGTGATTACGTTTTCGGGA<br>GTTATCGTCCCTACTACTACTA<br>CTACGGTATGGACGTC<br>SEQ ID NO: 3138 |
| | | AA | SYDIN<br>SEQ ID NO: 1254 | WMNPNSGGTGYAQKFQG<br>SEQ ID NO: 1411 | GGDYVFGSYRPYYYYYGMDV<br>SEQ ID NO: 1568 |
| iPS:360570 | 17B11.002.008 | NA | AGTTATGATATCAAC<br>SEQ ID NO: 2825 | TGGATGAACCCTAACAGTGGTG<br>GCACAGGCTATGCACAGAAGT<br>TCCAGGGC<br>SEQ ID NO: 2982 | GGGGGTGATTACGTTTTCGGGA<br>GTTATCGTCCCTACTACTACTA<br>CTACGGTATGGACGTC<br>SEQ ID NO: 3139 |
| | | AA | SYDIN<br>SEQ ID NO: 1255 | WMNPNSGGTGYAQKFQG<br>SEQ ID NO: 1412 | GGDYVFGSYRPYYYYYGMDV<br>SEQ ID NO: 1569 |
| iPS:362051 | 5G12.005.001 | NA | AGCTATGGCATACAC<br>SEQ ID NO: 2826 | GTTATATGGTATGATGCAAGTA<br>ATAAGTTCCATGCAGACGCCGT<br>GAAGGGC<br>SEQ ID NO: 2983 | GGAAAAGTGGCTGGTATGCCT<br>GAAGCTTTTGAAATC<br>SEQ ID NO: 3140 |
| | | AA | SYGIH<br>SEQ ID NO: 1256 | VIWYDASNKFHADAVKG<br>SEQ ID NO: 1413 | GKVAGMPEAFEI<br>SEQ ID NO: 1570 |

TABLE 5

Exemplary Light and Heavy Chain Nucleic Acid (“NA”) and Amino Acid (“AA”) Sequences

| iPS# | Ab | Type | LC | HC |
|---|---|---|---|---|
| iPS:336175 | 2C2.005 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGACAGCCTGAATGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 1885 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2042 |
| | | AA | QSVLTQPPSASGTPGQRVTISCSGSSSNIGSNTVNW YQHLPGTAPKLLIYTNNQRPSGVPDRFSGSKSGTS ASLAISGLQSEDEADYFCATFDDSLNGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 315 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEV TCVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKN QVSLTCLVKGFYPSDIAVEWESNGQPENNYKTTPP VLDSDGSFFLYSKLTVDKSRWQQGNVFSCSVMHEA LHNHYTQKSLSLSPGK SEQ ID NO: 472 |
| iPS:335914 | 4B1 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCGCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1886 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGGAA GTAATGAAAACTATGCAGACTCCGTGAAGGGCC GATTCACCATCTCCAGAGACAATTCCAAGAATA CGCTGTATCTGCACATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2043 |
| | | AA | DIQMTQSPSSLSASIGDRVTITCRASQDIRDYLGWY QQKPGKAPKRLIYGASSLQSGVPSRFSGSGSGTEFT LTISSLQPEDFATYYCLQHNNYPFTFGPGTKVDIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 316 | QVQLVESGGGVVQPGRSLRLSCAASGFTFSNFGM HWVRQAPGKGLEWVAVIWYDGSNENYADSVKG RFTISRDNSKNTLYLHMNSLRVADTAVYYCARDG TIFGVVLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 473 |
| iPS:335938 | 6H1 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1887 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGGAA<br>GTAATAAATACTATGCAGACTCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2044 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 317 | QVQLVESGGGVVQPGRSLRLSCAASGFTFSYFGM<br>HWVRQAPGKGLEWVAVIWYDGSNKYYADSVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 474 |
| iPS:335941 | 2F11 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATATTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGGA<br>AGTAATAAATACTATGCAGACTCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1888 | TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2045 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDIATYYCQQYDILLTFGGGTKVEI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 318 | QVQLVESGGGVVQPGRSLRLSCAASGFTFSSYGM<br>HWVRQAPGKGLEWVAVIWYDGSNKYYADSVKG<br>RFTISSDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 475 |
| iPS:335970 | 5C2 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGAACGGTGGCTGCACCATCTGTCTT<br>CATCTTCCCGCCATCTGATGAGCAGTTGAAATCT<br>GGAACTGCCTCTGTTGTGTGCCTGCTGAATAACT<br>TCTATCCCAGAGAGGCCAAAGTACAGTGGAAGG<br>TGGATAACGCCCTCCAATCGGGTAACTCCCAGG<br>AGAGTGTCACAGAGCAGGACAGCAAGGACAGC<br>ACCTACAGCCTCAGCAGCACCCTGACGCTGAGC<br>AAAGCAGACTACGAGAAACACAAAGTCTACGC<br>CTGCGAAGTCACCCATCAGGGCCTGAGCTCGCC<br>CGTCACAAAGAGCTTCAACAGGGGAGAGTGT<br>SEQ ID NO: 1889 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACAGT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2046 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 319 | QVPLVQSGAEVKKPGASVKVSCKASGYTFTGYYI HWVRQAPGQGLEWMGWINPDSGGTDYSQRFQGR FTMTRDTSISTAYMELNRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 476 |
| iPS:335978 | 13H12 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1890 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGA CTTGAGTGGATGGGGTGGATCAACCCTGACAGT GGTGGCACAGACTATTCACAGAGGTTTCAGGGC AGGTTCACCATGACCAGGGACACGTCCATCAGC ACAGCCTACATGGAACTGAGCAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2047 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIVMTQSPDSLAVSLGERATINCKSSQSVLSSSNNKNYIAWYQQKPGHPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC SEQ ID NO: 320 | QVPLVQSGAEVKKPGASVKVSCKASGYTFTGYYIHWVRQAPGQGLEWMGWINPDSGGTDYSQRFQGRFTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO: 477 |
| iPS:335986 | 11C1 | NA | GACATCGTGATGACCCAGTCTCCAGACTCCCTGTCTGTGTCTCTGGGCGAGAGGGCCACCATCAACTGCAAGTCCAGCCAGAGTGTTTTATCCAGCTCCAACAATAAGAACTACTTAGCTTGGTACCAACAGAAACCAGGACAGCCTCCTAACCTGCTCATTTACTGGACTTCTACCCGAGATTCCGGGGTCCCTGACCGATTCAGTGGCAGCGGGTCTGGGACAGATTTCACTCTCACCATCAACAGCCTGCAGGCTGAAGATGTGGCTGTTTATTACTGTCAGCAATATTATCGTACTCCGTGGACGTTCGGCCAAGGGACCAAGGTGGAAATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT SEQ ID NO: 1891 | CAGGTGCCGCTGGTACAGTCTGGGGCTGAGGTGAAGAAGCCTGGGGCCTCAGTGAAGGTCTCCTGCAAGGCTTCTGGATACACCTTCACCGGCTACTATATACACTGGGTGCGTCAGGCCCCTGGACAAGGGCTTGTGTGGATGGGGTGGATCAGCCCTAACAGTGGTGACACAAGCTATGCACAGAAGTTTCAGGACAGGGTCACCATGACCAGGGACACGTCCATCAGCACAGCCTATATGGAGCTGAGCAGACTGAGATCTGACGACACGGCCGTGTATTTCTGTACGAGAGAGGCCACGATTTTTGGAATGCTTATTGTACCATTTGACTACTGGGGCCAGGGAACCCTGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGTGAGGAGCAGTACGGCAGCACGTACCGTTGTGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA SEQ ID NO: 2048 |
| | | AA | DIVMTQSPDSLSVSLGERATINCKSSQSVLSSSNNKNYLAWYQQKPGQPPNLLIYWTSTRDSGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC SEQ ID NO: 321 | QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO: 478 |

TABLE 5-continued

| iPS# | Ab | Type | LC | HC |
|---|---|---|---|---|
| iPS:335994 | 12H11 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1892 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGACACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTACGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2049 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 322 | QVPLVQSGAEVKKPGASVKVSCKASGYTFTGYYI HWVRQAPGQGLEWMGWISPNNGDTNYAQKFQD RVTMTRDTSISTAYMELSRLRSDDTAVYYCTREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 479 |
| iPS:336024 | 18E3 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACAGGAGCCTGATGATTTTGCAGTGTATTACT GTCAGCAGTATGGTAGTTCACCGCTCACTTTCGG CGGAGGGACCAAGGTGGAGATCAAACGAACGG TGGCTGCACCATCTGTCTTCATCTTCCCGCCATC TGATGAGCAGTTGAAATCTGGAACTGCCTCTGT TGTGTGCCTGCTGAATAACTTCTATCCCAGAGA GGCCAAAGTACAGTGGAAGGTGGATAACGCCCT CCAATCGGGTAACTCCCAGGAGAGTGTCACAGA GCAGGACAGCAAGGACAGCACCTACAGCCTCA | CAGGTGCAGTTGCAGGAGTCGGGCCCAGGACTG GTGAAGCCTTCACAGACCCTGTCCCTCACCTGC ACTGTCTCTGGTGACTCCATCAGCAGTGGTGGTT ACTACTGGAGCTGGATCCGCCAGCACCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCAGCCTCCACCAAGGGCCCATCG GTCTTCCCCCTGGCACCCTCCTCCAAGAGCACCT CTGGGGGCACAGCGGCCCTGGGCTGCCTGGTCA AGGACTACTTCCCCGAACCGGTGACGGTGTCGT GGAACTCAGGCGCCCTGACCAGCGGCGTGCACA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GCAGCACCCTGACGCTGAGCAAAGCAGACTACG<br>AGAAACACAAAGTCTACGCCTGCGAAGTCACCC<br>ATCAGGGCCTGAGCTCGCCCGTCACAAAGAGCT<br>TCAACAGGGGAGAGTGT<br>SEQ ID NO: 1893 | CCTTCCCGGCTGTCCTACAGTCCTCAGGACTCTA<br>CTCCCTCAGCAGCGTGGTGACCGTGCCCTCCAG<br>CAGCTTGGGCACCCAGACCTACATCTGCAACGT<br>GAATCACAAGCCCAGCAACACCAAGGTGGACA<br>AGAAAGTTGAGCCCAAATCTTGTGACAAAACTC<br>ACACATGCCCACCGTGCCCAGCACCTGAACTCC<br>TGGGGGGACCGTCAGTCTTCCTCTTCCCCCCAAA<br>ACCCAAGGACACCCTCATGATCTCCCGGACCCC<br>TGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2050 |
| | | AA | EIVLTQSPGTLSLSPGERATLSCRASQSISYSYLAW<br>YQQKPGQAPRLLIYGASSRATGIPDRFSGSGSGTDF<br>TLTISRQEPDDFAVYYCQQYGSSPLTFGGGTKVEI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 323 | QVQLQESGPGLVKPSQTLSLTCTVSGDSISSGGYY<br>WSWIRQHPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 480 |
| iPS:336041 | 2G10_LC1 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGGTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGAACGGTG<br>GCTGCACCATCTGTCTTCATCTTCCCGCCATCTG<br>ATGAGCAGTTGAAATCTGGAACTGCCTCTGTTG<br>TGTGCCTGCTGAATAACTTCTATCCCAGAGAGG<br>CCAAAGTACAGTGGAAGGTGGATAACGCCCTCC<br>AATCGGGTAACTCCCAGGAGAGTGTCACAGAGC<br>AGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1894 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG<br>CTGGAGTGGGTGGCAGCTATATGGTTTGATGGA<br>AGTGATAAATACTATGCAGACTCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2051 |
| | | AA | EIVMTQSPATLSVSPGERATLSCRASQSVSSNLAW<br>YQQKPGQAPRLLIYGAATRATGIPARVSGSGSGTE<br>FTLTISSLQSEDFAVYYCQQYNNWPLTFGGGTKVE<br>IKRTVAAPSVFIFPPSDEQLKSGTASVVCLLNNFYP<br>REAKVQWKVDNALQSGNSQESVTEQDSKDSTYSL<br>SSTLTLSKADYEKHKVYACEVTHQGLSSPVTKSFN<br>RGEC<br>SEQ ID NO: 324 | QVQLVESGGGVVQPGRSLRLSCAASGFTFSNYGM<br>HWVRQAPGEGLEWVAAIWFDGSDKYYADSVKG<br>RFTISRDNSKNTLYLQMNSLRAEDTAVYYCARDQ<br>AIFGVVPDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 481 |
| iPS:336077 | 4H9.004 | NA | GACATTCAGATGACCCAGTCTCCATCCTCCCTGT<br>CTGCATCTGTAGGAGACAGAGTCACCATCACTT<br>GCCGGGCAAGTCAGGGCATTAGAAATGAGTTAG<br>GCTGGTATCAGCAGAAACCAGGGAAAGCCCCTA<br>AACGCCTGATCTATGGTGCATCCAGTTTGCAAA<br>GTGGGGTCCCATCAAGGTTCAGCGGCAGTGGAT<br>CTGGGACAGAGTTCACTCTCACAATCAGCAGCC<br>TGCAGCCTGAAGATTTTGTAACTTATTACTGTCT<br>ACAGCATAATAGTTACCCATTCACTTTCGGCCCT<br>GGGACCAAAGTGGATGTCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1895 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGGAA<br>GTAATAAATACTATGCAGACTCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2052 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASVGDRVTITCRASQGIRNELGW<br>YQQKPGKAPKRLIYGASSLQSGVPSRFSGSGSGTE<br>FTLTISSLQPEDFVTYYCLQHNSYPFTFGPGTKVDV<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 325 | QVQLVESGGGVVQPGRSLRLSCAASGFTFSYFGM<br>HWVRQAPGKGLEWVAVIWYDGSNKYYADSVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 482 |
| iPS:336088 | 6A5.004 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATATTGCAACATATTACTGTCAA<br>CAGTATGATGATCTATTCACTTTCGGCCCTGGGA<br>CCAAAGTGGATATCAAACGAACGGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTA<br>CAGTGGAAGGTGGATAACGCCCTCCAATCGGGT<br>AACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1896 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGGAA<br>ATAATAAATACTATGCAGACTCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2053 |
| | | AA | DIQMTQSPSSLSASVGDRVTITCQASQDITNYLNW<br>YQQKPGKAPKLLIYDASNLEPGVPSRFSGSGSGTD<br>FTFTISSLQPEDIATYYCQQYDDLFTFGPGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 326 | QVQLVESGGGVVQPGRSLRLSCAASGFSFSSYGM<br>HWVRQPPGKGLEWVAAIWYDGNNKYYADSVKG<br>RFTISRDSSKNTLYLQMNSLRAEDTAVYYCARDR<br>TIFGVVLEYLGQGTLVTVSSASTKGPSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV<br>KFNWYVDGVEVHNAKTKPCEEQYGSTYRCVSVL<br>TVLHQDWLNGKEYKCKVSNKALPAPIEKTISKAK<br>GQPREPQVYTLPPSREEMTKNQVSLTCLVKGFYPS<br>DIAVEWESNGQPENNYKTTPPVLDSDGSFFLYSKL<br>TVDKSRWQQGNVFSCSVMHEALHNHYTQKSLSL<br>SPGK<br>SEQ ID NO: 483 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:336099 | 17H11.004 | NA | GACATCCAGATGACCCAGTCTCCATCTTCCGTGT<br>CTGCATCTGTAGGAGACAGAGTCACCATCACTT<br>GTCGGGCGAGTCAGGGTCTTATCATCTGGTTAG<br>CCTGGTATCAGCAGAAACCGGGGAAAGCCCCTA<br>AACTCCTGATCTATGCTGCATCCAGTTTGCAAAG<br>TGGGGTCCCATCAAGGTTCAGCGGCAGTGGCTC<br>TGGGACAGATTTCACTCTCACCATCAGCAGCCT<br>ACAGCCTGAAGATTTTGCAACTTACTATTGTCAA<br>CAGACTAACAGTTTCCCTCCGACGTTCGGCCAA<br>GGGACCAAGGTGGAAATCAAACGAACGGTGGC<br>TGCACCATCTGTCTTCATCTTCCCGCCATCTGAT<br>GAGCAGTTGAAATCTGGAACTGCCTCTGTTGTG<br>TGCCTGCTGAATAACTTCTATCCCAGAGAGGCC<br>AAAGTACAGTGGAAGGTGGATAACGCCCTCCAA<br>TCGGGTAACTCCCAGGAGAGTGTCACAGAGCAG<br>GACAGCAAGGACAGCACCTACAGCCTCAGCAGC<br>ACCCTGACGCTGAGCAAAGCAGACTACGAGAA<br>ACACAAAGTCTACGCCTGCGAAGTCACCCATCA<br>GGGCCTGAGCTCGCCCGTCACAAAGAGCTTCAA<br>CAGGGGAGAGTGT<br>SEQ ID NO: 1897 | CAGGTGCAGCTGCAGGAGTCGGGCCCAGGACTG<br>GTGAAGCCTTCGGAGACCCTGTCCCTCACCTGC<br>ACTGTCTCTCAGGGCTCCATCAGTAGTTACTACT<br>GGAGCTGGATCCGGCAGCCCGCCGGGAAGGGA<br>CTAGAGTGGATTGGCCGTATCTATACCAGTGGG<br>AGCACCAACTACAACCCCTCCCTCAAGAGTCGA<br>GTCACCATGTCAATAGACACGTCCAAGAACCAG<br>TTCTCCCTGAAACTGAACTCTGTGACCGCCGCG<br>GACACGGCCGTGTATTACTGTGCGAGAGATGTA<br>GCAGTGGCTGGCTTTGACTACTGGGGCCAGGGA<br>ACCCTGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2054 |
| | | AA | DIQMTQSPSSVSASVGDRVTITCRASQGLIIWLAW<br>YQQKPGKAPKLLIYAASSLQSGVPSRFSGSGSGTD<br>FTLTISSLQPEDFATYYCQQTNSFPPTFGQGTKVEI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 327 | QVQLQESGPGLVKPSETLSLTCTVSQGSISSYYWS<br>WIRQPAGKGLEWIGRIYTSGSTNYNPSLKSRVTMS<br>IDTSKNQFSLKLNSVTAADTAVYYCARDVAVAGF<br>DYWGQGTLVTVSSASTKGPSVFPLAPSSKSTSGGT<br>AALGCLVKDYFPEPVTVSWNSGALTSGVHTFPAV<br>LQSSGLYSLSSVVTVPSSSLGTQTYICNVNHKPSNT<br>KVDKKVEPKSCDKTHTCPPCPAPELLGGPSVFLFP<br>PKPKDTLMISRTPEVTCVVVDVSHEDPEVKFNWY<br>VDGVEVHNAKTKPCEEQYGSTYRCVSVLTVLHQ<br>DWLNGKEYKCKVSNKALPAPIEKTISKAKGQPREP<br>QVYTLPPSREEMTKNQVSLTCLVKGFYPSDIAVE<br>WESNGQPENNYKTTPPVLDSDGSFFLYSKLTVDKS<br>RWQQGNVFSCSVMHEALHNHYTQKSLSLSPGK<br>SEQ ID NO: 484 |
| iPS:359621 | 17H11.004.001 | NA | GACATCCAGATGACCCAGTCTCCATCTTCCGTGT<br>CTGCATCTGTAGGAGACAGAGTCACCATCACTT<br>GTCGGGCGAGTCAGGGTCTTATCATCTGGTTAG<br>CCTGGTATCAGCAGAAACCGGGGAAAGCCCCTA<br>AACTCCTGATCTATGCTGCATCCAGTTTGCAAAG<br>TGGGGTCCCATCAAGGTTCAGCGGCAGTGGCTC<br>TGGGACAGATTTCACTCTCACCATCAGCAGCCT<br>ACAGCCTGAAGATTTTGCAACTTACTATTGTCAA<br>CAGACTAACAGTTTCCCTCCGACGTTCGGCCAA<br>GGGACCAAGGTGGAAATCAAACGAACGGTGGC<br>TGCACCATCTGTCTTCATCTTCCCGCCATCTGAT<br>GAGCAGTTGAAATCTGGAACTGCCTCTGTTGTG<br>TGCCTGCTGAATAACTTCTATCCCAGAGAGGCC<br>AAAGTACAGTGGAAGGTGGATAACGCCCTCCAA<br>TCGGGTAACTCCCAGGAGAGTGTCACAGAGCAG<br>GACAGCAAGGACAGCACCTACAGCCTCAGCAGC | CAGGTGCAGCTGCAGGAGTCGGGCCCAGGACTG<br>GTGAAGCCTTCGGAGACCCTGTCCCTCACCTGC<br>ACTGTCTCTGGGGGCTCCATCAGTAGTTACTACT<br>GGAGCTGGATCCGGCAGCCCGCCGGGAAGGGA<br>CTAGAGTGGATTGGCCGTATCTATACCAGTGGG<br>AGCACCAACTACAACCCCTCCCTCAAGAGTCGA<br>GTCACCATGTCAATAGACACGTCCAAGAACCAG<br>TTCTCCCTGAAACTGAACTCTGTGACCGCCGCG<br>GACACGGCCGTGTATTACTGTGCGAGAGATGTA<br>GCAGTGGCTGGCTTTGACTACTGGGGCCAGGGA<br>ACCCTGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | ACCCTGACGCTGAGCAAAGCAGACTACGAGAA ACACAAAGTCTACGCCTGCGAAGTCACCCATCA GGGCCTGAGCTCGCCCGTCACAAAGAGCTTCAA CAGGGGAGAGTGT SEQ ID NO: 1898 | AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2055 |
| | | AA | DIQMTQSPSSVSASVGDRVTITCRASQGLIIWLAW YQQKPGKAPKLLIYAASSLQSGVPSRFSGSGSGTD FTLTISSLQPEDFATYYCQQTNSFPPTFGQGTKVEI KRTVAAPSVFIFPPSDEQLKSGTASVVCLLNNFYPR EAKVQWKVDNALQSGNSQESVTEQDSKDSTYSLS STLTLSKADYEKHKVYACEVTHQGLSSPVTKSFN RGEC SEQ ID NO: 328 | QVQLQESGPGLVKPSETLSLTCTVSGGSISSYYWS WIRQPAGKGLEWIGRIYTSGSTNYNPSLKSRVTMS IDTSKNQFSLKLNSVTAADTAVYYCARDVAVAGF DYWGQGTLVTVSSASTKGPSVFPLAPSSKSTSGGT AALGCLVKDYFPEPVTVSWNSGALTSGVHTFPAV LQSSGLYSLSSVVTVPSSSLGTQTYICNVNHKPSNT KVDKKVEPKSCDKTHTCPPCPAPELLGGPSVFLFP PKPKDTLMISRTPEVTCVVVDVSHEDPEVKFNWY VDGVEVHNAKTKPCEEQYGSTYRCVSVLTVLHQ DWLNGKEYKCKVSNKALPAPIEKTISKAKGQPREP QVYTLPPSREEMTKNQVSLTCLVKGFYPSDIAVE WESNGQPENNYKTTPPVLDSDGSFFLYSKLTVDKS RWQQGNVFSCSVMHEALHNHYTQKSLSLSPGK SEQ ID NO: 485 |
| iPS:359781 | 4H9.004.001 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 1899 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2056 |
| | | AA | DIQMTQSPSSLSASVGDRVTITCRASQGIRNELGW YQQKPGKAPKLLIYGASSLQSGVPSRFSGSGSGTE FTLTISSLQPEDFVTYYCLQHNSYPFTFGQGTKVD VKRTVAAPSVFIFPPSDEQLKSGTASVVCLLNNFY PREAKVQWKVDNALQSGNSQESVTEQDSKDSTYS LSSTLTLSKADYEKHKVYACEVTHQGLSSPVTKSF NRGEC SEQ ID NO: 329 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDG TIFGVLLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 486 |
| iPS:360929 | 4H9.004.002 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 1900 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2057 |

TABLE 5-continued

| iPS# | Ab | Type | LC | HC |
|---|---|---|---|---|
| | | AA | DIQMTQSPSSLSASVGDRVTITCRASQGIRNELGW YQQKPGKAPKLLIYGASSLQSGVPSRFSGSGSGTE FTLTISSLQPEDFVTYYCLQHNSYPFTFGQGTKVD VKRTVAAPSVFIFPPSDEQLKSGTASVVCLLNNFY PREAKVQWKVDNALQSGNSQESVTEQDSKDSTYS LSSTLTLSKADYEKHKVYACEVTHQGLSSPVTKSF NRGEC SEQ ID NO: 330 | QVQLVESGGGVVQPGRSLRLSCAASGFTFSYFGM HWVRQAPGKGLEWVAVIWYDASNKYYADSVKG RFTISRDNSKNTLYLQMNSLRAEDTAVYYCARDG TIFGVLLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 487 |
| iPS:360936 | 4H9.004.003 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 1901 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2058 |
| | | AA | DIQMTQSPSSLSASVGDRVTITCRASQGIRNELGW YQQKPGKAPKLLIYGASSLQSGVPSRFSGSGSGTE FTLTISSLQPEDFVTYYCLQHNSYPFTFGQGTKVD VKRTVAAPSVFIFPPSDEQLKSGTASVVCLLNNFY PREAKVQWKVDNALQSGNSQESVTEQDSKDSTYS LSSTLTLSKADYEKHKVYACEVTHQGLSSPVTKSF NRGEC SEQ ID NO: 331 | QVQLVESGGGVVQPGRSLRLSCAASGFTFSYFGM HWVRQAPGKGLEWVAVIWYDGSNKYYADAVKG RFTISRDNSKNTLYLQMNSLRAEDTAVYYCARDG TIFGVLLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 488 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:360943 | 4H9.004.004 | NA | GACATTCAGATGACCCAGTCTCCATCCTCCCTGT<br>CTGCATCTGTAGGAGACAGAGTCACCATCACTT<br>GCCGGGCAAGTCAGGGCATTAGAAATGAGTTAG<br>GCTGGTATCAGCAGAAACCAGGGAAAGCCCCTA<br>AACTCCTGATCTATGGTGCATCCAGTTTGCAAA<br>GTGGGGTCCCATCAAGGTTCAGCGGCAGTGGAT<br>CTGGGACAGAGTTCACTCTCACAATCAGCAGCC<br>TGCAGCCTGAAGATTTTGTAACTTATTACTGTCT<br>ACAGCATAATAGTTACCCATTCACTTTCGGCCCT<br>GGGACCAAAGTGGATGTCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1902 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2059 |
| | | AA | DIQMTQSPSSLSASVGDRVTITCRASQGIRNELGW<br>YQQKPGKAPKLLIYGASSLQSGVPSRFSGSGSGTE<br>FTLTISSLQPEDFVTYYCLQHNSYPFTFGPGTKV<br>DVKRTVAAPSVFIFPPSDEQLKSGTASVVCLLNN<br>FYPREAKVQWKVDNALQSGNSQESVTEQDSKDST<br>YSLSSTLTLSKADYEKHKVYACEVTHQGLSSPVT<br>KSFNRGEC<br>SEQ ID NO: 332 | QVQLVESGGGVVQPGRSLRLSCAASGFTFSYFGM<br>HWVRQAPGKGLEWVAVIWYDASNKYYADAVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 489 |
| iPS:360949 | 4H9.004.005 | NA | GACATTCAGATGACCCAGTCTCCATCCTCCCTGT<br>CTGCATCTGTAGGAGACAGAGTCACCATCACTT<br>GCCGGGCAAGTCAGGGCATTAGAAATGAGTTAG<br>GCTGGTATCAGCAGAAACCAGGGAAAGCCCCTA<br>AACGCCTGATCTATGGTGCATCCAGTTTGCAAA<br>GTGGGGTCCCATCAAGGTTCAGCGGCAGTGGAT<br>CTGGGACAGAGTTCACTCTCACAATCAGCAGCC<br>TGCAGCCTGAAGATTTTGTAACTTATTACTGTCT<br>ACAGCATAATAGTTACCCATTCACTTTCGGCCA<br>AGGGACCAAAGTGGATGTCAAACGAACGGTGG<br>CTGCACCATCTGTCTTCATCTTCCCGCCATCTGA<br>TGAGCAGTTGAAATCTGGAACTGCCTCTGTTGT<br>GTGCCTGCTGAATAACTTCTATCCCAGAGAGGC<br>CAAAGTACAGTGGAAGGTGGATAACGCCCTCCA<br>ATCGGGTAACTCCCAGGAGAGTGTCACAGAGCA<br>GGACAGCAAGGACAGCACCTACAGCCTCAGCA<br>GCACCCTGACGCTGAGCAAAGCAGACTACGAGA | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | AACACAAAGTCTACGCCTGCGAAGTCACCCATC AGGGCCTGAGCTCGCCCGTCACAAAGAGCTTCA ACAGGGGAGAGTGT SEQ ID NO: 1903 | GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2060 |
| | | AA | DIQMTQSPSSLSASVGDRVTITCRASQGIRNELGW YQQKPGKAPKRLIYGASSLQSGVPSRFSGSGSGTE FTLTISSLQPEDFVTYYCLQHNSYPFTFGQGTKVD VKRTVAAPSVFIFPPSDEQLKSGTASVVCLLNNFY PREAKVQWKVDNALQSGNSQESVTEQDSKDSTYS LSSTLTLSKADYEKHKVYACEVTHQGLSSPVTKSF NRGEC SEQ ID NO: 333 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDG TIFGVLLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 490 |
| iPS:359761 | 4H9.004.006 | NA | GACATTCAGATGACCCAGTCTCCATCCTCCCTGT CTGCATCTGTAGGAGACAGAGTCACCATCACTT GCCGGGCAAGTCAGGGCATTAGAAATGAGTTAG GCTGGTATCAGCAGAAACCAGGGAAAGCCCCTA AACTCCTGATCTATGGTGCATCCAGTTTGCAAA GTGGGGTCCCATCAAGGTTCAGCGGCAGTGGAT CTGGGACAGAGTTCACTCTCACAATCAGCAGCC TGCAGCCTGAAGATTTTGTAACTTATTACTGTCT ACAGCATAATAGTTACCCATTCACTTTCGGCCA AGGGACCAAAGTGGATGTCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 1904 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGCAA GTAATAAATACTATGCAGACGCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATA GGACGATTTTTGGAGTGCTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA SEQ ID NO: 2061 |
| | | AA | DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC SEQ ID NO: 334 | QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO: 491 |
| iPS:360955 | 4B1.010 | NA | GACATCCAGATGACCCAGTCTCCATCCTCCCTGTCTGCATCTATAGGAGACAGAGTCACCATCACTTGCCGGGCAAGTCAGGACATTAGAGATTATTTAGGCTGGTATCAGCAGAAACCAGGGAAAGCCCCTAAGCTCCTGATCTATGGTGCATCCAGTTTGCAAAGTGGGGTCCCTTCAAGGTTCAGCGGCAGTGGATCTGGGACAGAATTCACTCTCACAATCAGCAGCCTGCAGCCTGAAGATTTCGCAACTTATTACTGTCTACAGCATAATAATTACCCCTTCACTTTCGGCCAAGGGACCAAAGTGGATATCAAACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT SEQ ID NO: 1905 | CAGGTGCAGCTGGTGGAGTCTGGGGGAGGCGTGGTCCAGCCTGGGAGGTCCCTGAGACTCTCCTGTGCAGCGTCTGGATTCACTTTCAGTAACTTTGGCATGCACTGGGTCCGCCAGGCTCCAGGCAAGGGGCTGGAGTGGGTGGCAGTTATATGGTATGATGCAAGTAATGAAAACTATGCAGACGCCGTGAAGGGCCGATTCACCATCTCCAGAGACAATTCCAAGAATACGCTGTATCTGCAAATGAACAGCCTGAGAGTCGCGGACACGGCTGTGTATTATTGTGCGCGAGATGGGACGATCTTTGGAGTGGTCTTGGGGGACTACTGGGGCCAGGGAACCCTGGTCACCGTCTCCTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGTGAGGAGCAGTACGGCAGCACGTACCGTTGTGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA SEQ ID NO: 2062 |
| | | AA | DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC SEQ ID NO: 335 | QVQLVESGGGVVQPGRSLRLSCAASGFTFSNFGMHWVRQAPGKGLEWVAVIWYDASNENYADAVKGRFTISRDNSKNTLYLQMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHED |

TABLE 5-continued

| iPS# | Ab | Type | LC | HC |
|---|---|---|---|---|
| Exemplary Light and Heavy Chain Nucleic Acid ("NA") and Amino Acid ("AA") Sequences | | | | |
| | | | | PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 492 |
| iPS:360962 | 4B1.011 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1906 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAATA<br>CGCTGTATCTGCAAATGAACAGCCTGAGAGTCG<br>CGGACACGGCTGTGTATTATTGTGCGCGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2063 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGQGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 336 | QVQLVESGGGVVQPGRSLRLSCAASGFTFSNFGM<br>HWVRQAPGKGLEWVAVIWYDASNENYADAVKG<br>RFTISRDNSKNTLYLQMNSLRVADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 493 |
| iPS:360968 | 4B1.012 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAATA<br>CGCTGTATCTGCAAATGAACAGCCTGAGAGTCG<br>CGGACACGGCTGTGTATTATTGTGCGCGAGATG |

TABLE 5-continued

| iPS# | Ab | Type | LC | HC |
|---|---|---|---|---|
| | | | GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1907 | GGACGATCTTTGGAGTGGTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2064 |
| | | AA | DIQMTQSPSSLSASIGDRVTITCRASQDIRDYL GWYQQKPGKAPKLLIYGASSLQSGVPSRFSGSG SGTEFTLTISSLQPEDFATYYCLQHNNYPFTFG PGTKVDIKRTVAAPSVFIFPPSDEQLKSGTASV VCLLNNFYPREAKVQWKVDNALQSGNSQESVTE QDSKDSTYSLSSTLTLSKADYEKHKVYACEVTH QGLSSPVTKSFNRGEC SEQ ID NO: 337 | QVQLVESGGGVVQPGRSLRLSCAASGFTFSNFGM HWVRQAPGKGLEWVAVIWYDASNENYADAVKG RFTISRDNSKNTLYLQMNSLRVADTAVYYCARDG TIFGVVLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 494 |
| iPS:360974 | 4B1.013 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1908 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGCAA GTAATGAAAACTATGCAGACTCCGTGAAGGGCC GATTCACCATCTCCAGAGACAATTCCAAGAATA CGCTGTATCTGCACATGAACAGCCTGAGAGTCG CGGACACGGCTGTGTATTATTGTGCGCGAGATG GGACGATCTTTGGAGTGGTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA |

Exemplary Light and Heavy Chain Nucleic Acid ("NA") and Amino Acid ("AA") Sequences TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2065 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>RTVAAPSVFIFPPSDEQLKSGTASVVCLLNNFYPRE<br>AKVQWKVDNALQSGNSQESVTEQDSKDSTYSLSS<br>SKSTSGGTAALGCLVKDYFPEPVTVSWNSGALTS<br>TLTLSKADYEKHKVYACEVTHQGLSSPVTKSFNR<br>GEC<br>SEQ ID NO: 338 | QVQLVESGGGVVQPGRSLRLSCAASGFTFSNFGM<br>HWVRQAPGKGLEWVAVIWYDASNENYADSVKG<br>RFTISRDNSKNTLYLHMNSLRVADTAVYYCARDG<br>TIFGVVLGDYWGQGTLVTVSSASTKGPSVFPLAPS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 495 |
| iPS:360978 | 4B1.014 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1909 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGGAA<br>GTAATGAAAACTATGCAGACGCCGTGAAGGGCC<br>GATTCACCATCTCCAGAGACAATTCCAAGAATA<br>CGCTGTATCTGCACATGAACAGCCTGAGAGTCG<br>CGGACACGGCTGTGTATTATTGTGCGCGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2066 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGQGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 339 | QVQLVESGGGVVQPGRSLRLSCAASGFTFSNFGM HWVRQAPGKGLEWVAVIWYDGSNENYADAVKG RFTISRDNSKNTLYLHMNSLRVADTAVYYCARDG TIFGVVLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 496 |
| iPS:359785 | 4B1.015 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCAA GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1910 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCTCCAGGCAAGGGGC TGGAGTGGGTGGCAGTTATATGGTATGATGCAA GTAATGAAAACTATGCAGACGCCGTGAAGGGCC GATTCACCATCTCCAGAGACAATTCCAAGAATA CGCTGTATCTGCAAATGAACAGCCTGAGAGTCG AGGACACGGCTGTGTATTATTGTGCGCGAGATA GGACGATCTTTGGAGTGGTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2067 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGQGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 340 | QVQLVESGGGVVQPGRSLRLSCAASGFTFSNFGM HWVRQAPGKGLEWVAVIWYDASNENYADAVKG RFTISRDNSKNTLYLQMNSLRVEDTAVYYCARDR TIFGVVLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 497 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:360982 | 4B1.016 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1911 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCTCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAATA<br>CGCTGTATCTGCAAATGAACAGCCTGAGAGTCG<br>AGGACACGGCTGTGTATTATTGTGCGCGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2068 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 341 | QVQLVESGGGVVQPGRSLRLSCAASGFTFSNFGM<br>HWVRQAPGKGLEWVAVIWYDASNENYADAVKG<br>RFTISRDNSKNTLYLQMNSLRVEDTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 498 |
| iPS:335922 | 18F2 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGGAA<br>GTAATGAAAACTATGCAGACTCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1912 | GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2069 |
| | | AA | DIQMTQSPSSLSASIGDRVTITCRASQDLRNYLGW<br>YHQKPGKAPKRLIYGASSLQSGVPSRFSGSGSGTE<br>FTLTISSLQPEDFATYYCLQHNNYPFTFGPGTKV<br>DIKRTVAAPSVFIFPPSDEQLKSGTASVVCLLNN<br>FYPREAKVQWKVDNALQSGNSQESVTEQDSKDST<br>YSLSSTLTLSKADYEKHKVYACEVTHQGLSSPVT<br>KSFNRGEC<br>SEQ ID NO: 342 | QVQLVESGGGVVQPGRSLRLSCAASGFTFSNFGM<br>HWVRQAPGKGLEWVAVIWYDGSNENYADSVKG<br>RFTISRDNSKNTLYLHMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 499 |
| iPS:360986 | 18F2.002 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1913 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2070 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 343 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 500 |
| iPS:360995 | 18F2.003 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1914 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2071 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 344 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 501 |
| iPS:360999 | 18F2.004 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1915 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2072 |
| | | AA | DIQMTQSPSSLSASIGDRVTITCRASQDLRNYLGW<br>YHQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 345 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 502 |
| iPS:361005 | 18F2.005 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1916 | GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2073 |
| | | AA | DIQMTQSPSSLSASIGDRVTITCRASQDLRNYLGW<br>YQQKPGKAPKRLIYGASSLQSGVPSRFSGSGSGTE<br>FTLTISSLQPEDFATYYCLQHNNYPFTFGPGTKVD<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 346 | QVQLVESGGGVVQPGRSLRLSCAASGFTFSNFGM<br>HWVRQAPGKGLEWVAVIWYDASNENYADAVKG<br>IRFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 503 |
| iPS:361009 | 18F2.006 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1917 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2074 |
| | | AA | DIQMTQSPSSLSASIGDRVTITCRASQDLRNYLGW<br>YQQKPGKAPKRLIYGASSLQSGVPSRFSGSGSGTE<br>FTLTISSLQPEDFATYYCLQHNNYPFTFGPGTKV<br>DIKRTVAAPSVFIFPPSDEQLKSGTASVVCLLNN<br>FYPREAKVQWKVDNALQSGNSQESVTEQDSKDST<br>YSLSSTLTLSKADYEKHKVYACEVTHQGLSSPVT<br>KSFNRGEC<br>SEQ ID NO: 347 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 504 |
| iPS:361013 | 18F2.007 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1918 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCACATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2075 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASIGDRVTITCRASQDLRNYLGW<br>YHQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 348 | QVQLVESGGGVVQPGRSLRLSCAASGFTFSNFGM<br>HWVRQAPGKGLEWVAVIWYDASNENYADAVKG<br>RFTISRDNSKNTLYLHMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 505 |
| iPS:361017 | 18F2.008 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCACCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1919 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2076 |
| | | AA | DIQMTQSPSSLSASIGDRVTITCRASQDLRNYLGW<br>YHQKPGKAPKRLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 349 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 506 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:361021 | 18F2.009 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1920 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGGAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2077 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 350 | QVQLVESGGGVVQPGRSLRLSCAASGFTFSNFGM<br>HWVRQAPGKGLEWVAVIWYDGSNENYADAVKG<br>RFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 507 |
| iPS:361028 | 18F2.010 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACTCCGTGAAGGGCC<br>GATTCACCATCTCCAGAGACAATTCCAAGAACA<br>CGCTGTATCTGCAAATGAACAGCCTGAGAGCCG<br>CGGACACGGCTGTGTATTACTGTGCGAGAGATG<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1921 | CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2078 |
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 351 | QVQLVESGGGVVQPGRSLRLSCAASGFTFSNFGM<br>HWVRQAPGKGLEWVAVIWYDGSNENYADAVKG<br>RFTISRDNSKNTLYLQMNSLRAADTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 508 |
| iPS:360535 | 18F2.011 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1922 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>AGGACACGGCTGTGTATTACTGTGCGAGAGATA<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2079 |
| | | AA | DIQMTQSPSSLSASIGDRVTITCRASQDLRNYLGW YQQKPGKAPKLLIYGASSLQSGVPSRFSGSGSGTE FTLTISSLQPEDFATYYCLQHNNYPFTFGQGTKV DIKRTVAAPSVFIFPPSDEQLKSGTASVVCLLNN FYPREAKVQWKVDNALQSGNSQESVTEQDSKDST YSLSSTLTLSKADYEKHKVYACEVTHQGLSSPVT KSFNRGEC SEQ ID NO: 352 | QVQLVESGGGVVQPGRSLRLSCAASGFTFSNFGM HWVRQAPGKGLEWVAVIWYDASNENYADAVKG RFTISRDNSKNTLYLQMNSLRAEDTAVYYCARDR TIFGVVLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 509 |
| iPS:361035 | 18F2.012 | NA | GACATCCAGATGACCCAGTCTCCATCCTCCCTGT CTGCATCTATAGGAGACAGAGTCACCATCACTT GCCGGGCAAGTCAGGACCTTAGAAATTATTTAG GCTGGTATCAACAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1923 | CAGGTGCAGCTGGTGGAGTCTGGGGGAGGCGTG GTCCAGCCTGGGAGGTCCCTGAGACTCTCCTGT GCAGCGTCTGGATTCACTTTCAGTAACTTTGGCA TGCACTGGGTCCGCCAGGCCCCAGGCAAGGGGC TGGAGTGGGTGGCAGTTATATGGTATGATGCAA GTAATGAAAACTATGCAGACGCCGTGAAGGGCC GATTCACCATCTCCAGAGACAATTCCAAGAACA CGCTGTATCTGCAAATGAACAGCCTGAGAGCCG AGGACACGGCTGTGTATTACTGTGCGAGAGATG GGACGATCTTTGGAGTGGTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2080 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASIGDRVTITCRASQDLRNYLGW<br>YQQKPGKAPKLLIYGASSLQSGVPSRFSGSGSGTE<br>FTLTISSLQPEDFATYYCLQHNNYPFTFGPGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 353 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAEDTAVYYCARDG<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 510 |
| iPS:359940 | 2F11.002 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA<br>GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1924 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2081 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 354 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 511 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:361039 | 2F11.003 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA<br>GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1925 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2082 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 355 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 512 |
| iPS:361043 | 2F11.004 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATATTGCAACATATTACTGTC<br>AACAGTATGATATTCTCCTCACTTTCGGCGGAG<br>GGACCAAGGTGGAGATCAAGCGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1926 | GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2083 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDIATYYCQQYDILLTFGGGTKVEI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 356 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 513 |
| iPS:361049 | 2F11.005 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATTTTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA<br>GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1927 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2084 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDFATYYCQQYDILLTFGGGTKVEI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 357 | QVQLVESGGGVVQPGRSLRLSCAASGFTFSSYGM<br>HWVRQAPGKGLEWVAVIWYDASNKYYADAVKG<br>RFTISRDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 514 |
| iPS:361055 | 2F11.006 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATATTGCAACATATTACTGTC<br>AACAGTATGATATTCTCCTCACTTTCGGCGGAG<br>GGACCAAGGTGGAGATCAAGCGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1928 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2085 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDIATYYCQQYDILLTFGGGTKVEI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 358 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 515 |
| iPS:361059 | 2F11.007 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATTTTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA<br>GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1929 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGCGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2086 |
| | | AA | DIQMTQSPSSLSASVGDRVTITCQASQDISNYLNW<br>YQQKPGKAPKLLIYDASNLETGVPSRFSGSGSGTD<br>FSFTISSLQPEDFATYYCQQYDILLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 359 | QVQLVESGGGVVQPGRSLRLSCAASGFTFSSYGM<br>HWVRQAPGKGLEWVAVIWYDASNKYYADAVKG<br>RFTISSDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 516 |
| iPS:361063 | 2F11.008 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTTTCACCATCAGCAGCCT<br>GCAGCCTGAAGATATTGCAACATATTACTGTCA<br>ACAGTATGATATTCTCCTCACTTTCGGCGGAGG | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGCA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GACCAAGGTGGAGATCAAGCGAACGGTGGCTG CACCATCTGTCTTCATCTTCCCGCCATCTGATGA GCAGTTGAAATCTGGAACTGCCTCTGTTGTGTGC CTGCTGAATAACTTCTATCCCAGAGAGGCCAAA GTACAGTGGAAGGTGGATAACGCCCTCCAATCG GGTAACTCCCAGGAGAGTGTCACAGAGCAGGAC AGCAAGGACAGCACCTACAGCCTCAGCAGCACC CTGACGCTGAGCAAAGCAGACTACGAGAAACA CAAAGTCTACGCCTGCGAAGTCACCCATCAGGG CCTGAGCTCGCCCGTCACAAAGAGCTTCAACAG GGGAGAGTGT SEQ ID NO: 1930 | AGGACGATTTTTGGAGTGGTTCTTGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2087 |
| | | AA | DIQMTQSPSSLSASVGDRVTITCQASQDISNYLNW YQQKPGKAPKLLIYDASNLETGVPSRFSGSGSGTD FSFTISSLQPEDIATYYCQQYDILLTFGGGTKVEI KRTVAAPSVFIFPPSDEQLKSGTASVVCLLNNFYP REAKVQWKVDNALQSGNSQESVTEQDSKDSTYSLS STLTLSKADYEKHKVYACEVTHQGLSSPVTKSFNR GEC SEQ ID NO: 360 | QVQLVESGGGVVQPGRSLRLSCAASGFTFSSYGM HWVRQAPGKGLEWVAVIWYDASNKYYADAVKG RFTISRDNSKNTLYLQMNSLRAEDTAVYYCARDR TIFGVVLDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 517 |
| iPS:359949 | 2F11.009 | NA | GACATCCAGATGACCCAGTCTCCATCCTCCCTGT CTGCATCTGTAGGAGACAGAGTCACCATCACTT GCCAGGCGAGTCAGGACATTAGCAACTATTTAA ATTGGTATCAGCAGAAACCAGGGAAAGCCCCTA AGCTCCTGATCTACGATGCATCCAATTTGGAAA CAGGGGTCCCATCAAGGTTCAGTGGAAGTGGAT CTGGGACAGATTTTAGTCTCACCATCAGCAGCC TGCAGCCTGAAGATTTTGCAACATATTACTGTCA ACAGTATGATATTCTCCTCACTTTCGGCGGAGG GACCAAGGTGGAGATCAAGCGAACGGTGGCTG CACCATCTGTCTTCATCTTCCCGCCATCTGATGA GCAGTTGAAATCTGGAACTGCCTCTGTTGTGTGC CTGCTGAATAACTTCTATCCCAGAGAGGCCAAA GTACAGTGGAAGGTGGATAACGCCCTCCAATCG GGTAACTCCCAGGAGAGTGTCACAGAGCAGGAC AGCAAGGACAGCACCTACAGCCTCAGCAGCACC CTGACGCTGAGCAAAGCAGACTACGAGAAACA CAAAGTCTACGCCTGCGAAGTCACCCATCAGGG CCTGAGCTCGCCCGTCACAAAGAGCTTCAACAG GGGAGAGTGT SEQ ID NO: 1931 | CAGGTGCAACTGGTGGAGTCTGGGGGAGGCGTG GTCCAGCCTGGGAGGTCCCTGAGACTCTCCTGT GCAGCGTCTGGATTCACCTTCAGTAGCTATGGC ATGCACTGGGTCCGCCAGGCTCCAGGCAAGGGG CTGGAGTGGGTGGCAGTTATATGGTATGATGCA AGTAATAAATACTATGCAGACTCCGTGAAGGGC CGATTCACCATCTCCAGGGACAATTCCAAGAAC ACGCTGTATCTGCAAATGAACAGCCTGAGAGCC GAGGACACGGCTGTGTATTACTGTGCGAGAGAT AGGACGATTTTTGGAGTGGTTCTTGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2088 |
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 361 | QVQLVESGGGVVQPGRSLRLSCAASGFTFSSYGM<br>HWVRQAPGKGLEWVAVIWYDASNKYYADSVKG<br>RFTISRDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>ALTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 518 |
| iPS:359956 | 2F11.010 | NA | GACATCCAGATGACCCAGTCTCCATCCTCCCTGT<br>CTGCATCTGTAGGAGACAGAGTCACCATCACTT<br>GCCAGGCGAGTCAGGACATTAGCAACTATTTAA<br>ATTGGTATCAGCAGAAACCAGGGAAAGCCCCTA<br>AGCTCCTGATCTACGATGCATCCAATTTGGAAA<br>CAGGGGTCCCATCAAGGTTCAGTGGAAGTGGAT<br>CTGGGACAGATTTTAGTCTCACCATCAGCAGCC<br>TGCAGCCTGAAGATTTTGCAACATATTACTGTCA<br>ACAGTATGATATTCTCCTCACTTTCGGCGGAGG<br>GACCAAGGTGGAGATCAAGCGAACGGTGGCTG<br>CACCATCTGTCTTCATCTTCCCGCCATCTGATGA<br>GCAGTTGAAATCTGGAACTGCCTCTGTTGTGTGC<br>CTGCTGAATAACTTCTATCCCAGAGAGGCCAAA<br>GTACAGTGGAAGGTGGATAACGCCCTCCAATCG<br>GGTAACTCCCAGGAGAGTGTCACAGAGCAGGAC<br>AGCAAGGACAGCACCTACAGCCTCAGCAGCACC<br>CTGACGCTGAGCAAAGCAGACTACGAGAAACA<br>CAAAGTCTACGCCTGCGAAGTCACCCATCAGGG<br>CCTGAGCTCGCCCGTCACAAAGAGCTTCAACAG<br>GGGAGAGTGT<br>SEQ ID NO: 1932 | CAGGTGCAACTGGTGGAGTCTGGGGGAGGCGTG<br>GTCCAGCCTGGGAGGTCCCTGAGACTCTCCTGT<br>GCAGCGTCTGGATTCACCTTCAGTAGCTATGGC<br>ATGCACTGGGTCCGCCAGGCTCCAGGCAAGGGG<br>CTGGAGTGGGTGGCAGTTATATGGTATGATGGA<br>AGTAATAAATACTATGCAGACGCCGTGAAGGGC<br>CGATTCACCATCTCCAGGGACAATTCCAAGAAC<br>ACGCTGTATCTGCAAATGAACAGCCTGAGAGCC<br>GAGGACACGGCTGTGTATTACTGTGCGAGAGAT<br>AGGACGATTTTTGGAGTGGTTCTTGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2089 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASVGDRVTITCQASQDISNYLNW<br>YQQKPGKAPKLLIYDASNLETGVPSRFSGSGSGTD<br>FSLTISSLQPEDFATYYCQQYDILLTFGGGTKVEI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 362 | QVQLVESGGGVVQPGRSLRLSCAASGFTFSSYGM<br>HWVRQAPGKGLEWVAVIWYDGSNKYYADAVKG<br>RFTISRDNSKNTLYLQMNSLRAEDTAVYYCARDR<br>TIFGVVLDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 519 |
| iPS:359865 | 6H1.002 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>AGCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1933 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2090 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 363 | QVQLVESGGGVVQPGRSLRLSCAASGFTFSYFGM<br>HWVRQAPGKGLEWVAVIWYDASNKYYADAVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 520 |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| iPS:359869 | 6H1.003 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>AGCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1934 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATA<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2091 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 364 | QVQLVESGGGVVQPGRSLRLSCAASGFTFSYFGM<br>HWVRQAPGKGLEWVAVIWYDASNKYYADAVKG<br>RFTISRDNSKNTLYLQMNSLRAEDTAVYYCARDR<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 521 |
| iPS:359873 | 6H1.004 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1935 | CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2092 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGQGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 365 | QVQLVESGGGVVQPGRSLRLSCAASGFTFSYFGM<br>HWVRQAPGKGLEWVAVIWYDASNKYYADAVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 522 |
| iPS:359877 | 6H1.005 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1936 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATA<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>ACCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2093 |
| | | AA | DIQMTQSPSSLSASIGDRVTITCRASQDIRDYLGWY QQKPGKAPKLLIYGASSLQSGVPSRFSGSGSGTEFT LTISSLQPEDFATYYCLQHNNYPFTFGQGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 366 | QVQLVESGGGVVQPGRSLRLSCAASGFTFSYFGM HWVRQAPGKGLEWVAVIWYDASNKYYADAVKG RFTISRDNSKNTLYLQMNSLRAEDTAVYYCARDR TIFGVLLGDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 523 |
| iPS:361067 | 6H1.006 | NA | GACATCCAGATGACCCAGTCTCCATCCTCCCTGT CTGCATCTATAGGAGACAGAGTCACCATCACTT GCCGGGCAAGTCAGGACATTAGAGATTATTTAG GCTGGTATCAGCAGAAACCAGGGAAAGCCCCTA AGCTCCTGATCTATGGTGCATCCAGTTTGCAAA GTGGGGTCCCTTCAAGGTTCAGCGGCAGTGGAT CTGGGACAGAATTCACTCTCACAATCAGCAGCC TGCAGCCTGAAGATTTCGCAACTTATTACTGTCT ACAGCATAATAATTACCCCTTCACTTTCGGCCCT GGGACCAAAGTGGATATCAAACGAACGGTGGCT GCACCATCTGTCTTCATCTTCCCGCCATCTGATG AGCAGTTGAAATCTGGAACTGCCTCTGTTGTGT GCCTGCTGAATAACTTCTATCCCAGAGAGGCCA AAGTACAGTGGAAGGTGGATAACGCCCTCCAAT CGGGTAACTCCCAGGAGAGTGTCACAGAGCAGG ACAGCAAGGACAGCACCTACAGCCTCAGCAGCA CCCTGACGCTGAGCAAAGCAGACTACGAGAAAC ACAAAGTCTACGCCTGCGAAGTCACCCATCAGG GCCTGAGCTCGCCCGTCACAAAGAGCTTCAACA GGGGAGAGTGT SEQ ID NO: 1937 | CAGGTGCAGCTGGTGGAGTCTGGGGGAGGCGTG GTCCAGCCTGGGAGGTCCCTGAGACTCTCCTGT GCAGCGTCTGGATTCACCTTCAGTTACTTTGGCA TGCACTGGGTCCGCCAGGCTCCAGGCAAGGGGC TGGAGTGGGTGGCAGTTATATGGTATGATGGAA GTAATAAATACTATGCAGACTCCGTGAAGGGCC GCTTCACCATCTCCAGAGACAATTCCAAGAACA CGCTGTATCTGCAAATGAACAGCCTGAGAGCCG AGGACACGGCTGTGTATTACTGTGCGCGAGATG GGACGATTTTTGGAGTGCTCTTGGGGGACTACT GGGGCCAGGGAACCCTGGTCACCGTCTCCTCAG CCTCCACCAAGGGCCCATCGGTCTTCCCCCTGGC ACCCTCCTCCAAGAGCACCTCTGGGGGCACAGC GGCCCTGGGCTGCCTGGTCAAGGACTACTTCCC CGAACCGGTGACGGTGTCGTGGAACTCAGGCGC CCTGACCAGCGGCGTGCACACCTTCCCGGCTGT CCTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC ATCCGTGATGCATGAGGCTCTGCACAACCACTAC ACGCAGAAGAGCCTCTCCCTGTCTCCGGGTAAA SEQ ID NO: 2094 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 367 | QVQLVESGGGVVQPGRSLRLSCAASGFTFSYFGM<br>HWVRQAPGKGLEWVAVIWYDGSNKYYADSVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 524 |
| iPS:361071 | 6H1.007 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1938 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACTCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2095 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>AEC<br>SEQ ID NO: 368 | QVQLVESGGGVVQPGRSLRLSCAASGFTFSYFGM<br>HWVRQAPGKGLEWVAVIWYDASNKYYADSVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 525 |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| iPS:361075 | 6H1.008 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCTCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCCT<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 1939 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGGAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATG<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2096 |
| | | AA | DIQMTQSPSSLSASIGDRVTITCRASQDIRDYLGWY<br>QQKPGKAPKLLIYGASSLQSGVPSRFSGSGSGTEFT<br>LTISSLQPEDFATYYCLQHNNYPFTFGPGTKVDIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 369 | QVQLVESGGGVVQPGRSLRLSCAASGFTFSYFGM<br>HWVRQAPGKGLEWVAVIWYDGSNKYYADAVKG<br>RFTISRDNSKNTLYLQMNSLRAEDTAVYYCARDG<br>TIFGVLLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 526 |
| iPS:361079 | 6A5.004.001 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCCTGGG<br>ACCAAAGTGGATATCAAACGAACGGTGGCTGCA<br>CCATCTGTCTTCATCTTCCCGCCATCTGATGAGC<br>AGTTGAAATCTGGAACTGCCTCTGTTGTGTGCCT<br>GCTGAATAACTTCTATCCCAGAGAGGCCAAAGT<br>ACAGTGGAAGGTGGATAACGCCCTCCAATCGGG<br>TAACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | AAGTCTACGCCTGCGAAGTCACCCATCAGGGCC TGAGCTCGCCCGTCACAAAGAGCTTCAACAGGG GAGAGTGT SEQ ID NO: 1940 | GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC GTGATGCATGAGGCTCTGCACAACCACTACACG CAGAAGAGCCTCTCCCTGTCTCCGGGTAAA SEQ ID NO: 2097 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGPGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 370 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 527 |
| iPS:361085 | 6A5.004.002 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT AGCAGCCTGAAGATATTGCAACATATTACTGTCA ACAGTATGATGATCTATTCACTTTCGGCCCTGGG ACCAAAGTGGATATCAAACGAACGGTGGCTGCA CCATCTGTCTTCATCTTCCCGCCATCTGATGAGC AGTTGAAATCTGGAACTGCCTCTGTTGTGTGCCT GCTGAATAACTTCTATCCCAGAGAGGCCAAAGT ACAGTGGAAGGTGGATAACGCCCTCCAATCGGG TAACTCCCAGGAGAGTGTCACAGAGCAGGACAG CAAGGACAGCACCTACAGCCTCAGCAGCACCCT GACGCTGAGCAAAGCAGACTACGAGAAACACA AAGTCTACGCCTGCGAAGTCACCCATCAGGGCC TGAGCTCGCCCGTCACAAAGAGCTTCAACAGGG GAGAGTGT SEQ ID NO: 1941 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2098 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDIATYYCQQYDDLFTFGPGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 371 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 528 |
| iPS:361091 | 6A5.004.003 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCCTGGG<br>ACCAAAGTGGATATCAAACGAACGGTGGCTGCA<br>CCATCTGTCTTCATCTTCCCGCCATCTGATGAGC<br>AGTTGAAATCTGGAACTGCCTCTGTTGTGTGCCT<br>GCTGAATAACTTCTATCCCAGAGAGGCCAAAGT<br>ACAGTGGAAGGTGGATAACGCCCTCCAATCGGG<br>TAACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1942 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2099 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGPGTKVDI<br>KRTVAAPSVFIFPPSDEQLKSGTASVVCLLNNFYP<br>REAKVQWKVDNALQSGNSQESVTEQDSKDSTYSLS<br>STLTLSKADYEKHKVYACEVTHQGLSSPVTKSFNR<br>GEC<br>SEQ ID NO: 372 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSSASTKGPSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | KFNWYVDGVEVHNAKTKPCEEQYGSTYRCVSVL TVLHQDWLNGKEYKCKVSNKALPAPIEKTISKAK GQPREPQVYTLPPSREEMTKNQVSLTCLVKGFYPS DIAVEWESNGQPENNYKTTPPVLDSDGSFFLYSKL TVDKSRWQQGNVFSCSVMHEALHNHYTQKSLSL SPGK SEQ ID NO: 529 |
| iPS:361095 | 6A5.004.004 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTTTCACCATCAGCAGCCTG CAGCCTGAAGATTTTGCAACATATTACTGTCAA CAGTATGATGATCTATTCACTTTCGGCCCTGGGA CCAAAGTGGATATCAAACGAACGGTGGCTGCAC CATCTGTCTTCATCTTCCCGCCATCTGATGAGCA GTTGAAATCTGGAACTGCCTCTGTTGTGTGCCTG CTGAATAACTTCTATCCCAGAGAGGCCAAAGTA CAGTGGAAGGTGGATAACGCCCTCCAATCGGGT AACTCCCAGGAGAGTGTCACAGAGCAGGACAG CAAGGACAGCACCTACAGCCTCAGCAGCACCCT GACGCTGAGCAAAGCAGACTACGAGAAACACA AAGTCTACGCCTGCGAAGTCACCCATCAGGGCC TGAGCTCGCCCGTCACAAAGAGCTTCAACAGGG GAGAGTGT SEQ ID NO: 1943 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT AGGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC GTGATGCATGAGGCTCTGCACAACCACTACACG CAGAAGAGCCTCTCCCTGTCTCCGGGTAAA SEQ ID NO: 2100 |
| | | AA | DIQMTQSPSSLSASVGDRVTITCQASQDITNYLNW YQQKPGKAPKLLIYDASNLEPGVPSRFSGSGSGTD FTFTISSLQPEDFATYYCQQYDDLFTFGPGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 373 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 530 |
| iPS:361101 | 6A5.004.005 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATATTGCAACATATTACTGTCA ACAGTATGATGATCTATTCACTTTCGGCCCTGGG | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | ACCAAAGTGGATATCAAACGAACGGTGGCTGCA<br>CCATCTGTCTTCATCTTCCCGCCATCTGATGAGC<br>AGTTGAAATCTGGAACTGCCTCTGTTGTGTGCCT<br>GCTGAATAACTTCTATCCCAGAGAGGCCAAAGT<br>ACAGTGGAAGGTGGATAACGCCCTCCAATCGGG<br>TAACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1944 | GGACGATTTTTGGAGTGGTCCTTGAGTACCTCG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AAACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2101 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDIATYYCQQYDDLFTFGPGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 374 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSSASTKGPSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV<br>KFNWYVDGVEVHNAKTKPCEEQYGSTYRCVSVL<br>TVLHQDWLNGKEYKCKVSNKALPAPIEKTISKAK<br>GQPREPQVYTLPPSREEMTKNQVSLTCLVKGFYPS<br>DIAVEWESNGQPENNYKTTPPVLDSDGSFFLYSKL<br>TVDKSRWQQGNVFSCSVMHEALHNHYTQKSLSL<br>SPGK<br>SEQ ID NO: 531 |
| iPS:361105 | 6A5.004.006 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATTTTGCAACATATTACTGTCAA<br>CAGTATGATGATCTATTCACTTTCGGCCCTGGGA<br>CCAAAGTGGATATCAAACGAACGGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTA<br>CAGTGGAAGGTGGATAACGCCCTCCAATCGGGT<br>AACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1945 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACCTCG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2102 |
| | | AA | DIQMTQSPSSLSASVGDRVTITCQASQDITNYLNW<br>YQQKPGKAPKLLIYDASNLEPGVPSRFSGSGSGTD<br>FTFTISSLQPEDFATYYCQQYDDLFTFGPGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 375 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSSASTKGPSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV<br>KFNWYVDGVEVHNAKTKPCEEQYGSTYRCVSVL<br>TVLHQDWLNGKEYKCKVSNKALPAPIEKTISKAK<br>GQPREPQVYTLPPSREEMTKNQVSLTCLVKGFYPS<br>DIAVEWESNGQPENNYKTTPPVLDSDGSFFLYSKL<br>TVDKSRWQQGNVFSCSVMHEALHNHYTQKSLSL<br>SPGK<br>SEQ ID NO: 532 |
| iPS:361109 | 6A5.004.007 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTTTCACCATCAGCAGCCTG<br>CAGCCTGAAGATATTGCAACATATTACTGTCAA<br>CAGTATGATGATCTATTCACTTTCGGCCCTGGGA<br>CCAAAGTGGATATCAAACGAACGGTGGCTGCAC<br>CATCTGTCTTCATCTTCCCGCCATCTGATGAGCA<br>GTTGAAATCTGGAACTGCCTCTGTTGTGTGCCTG<br>CTGAATAACTTCTATCCCAGAGAGGCCAAAGTA<br>CAGTGGAAGGTGGATAACGCCCTCCAATCGGGT<br>AACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1946 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2103 |

TABLE 5-continued

| iPS# | Ab | Type | LC | HC |
|---|---|---|---|---|
| | | AA | DIQMTQSPSSLSASVGDRVTITCQASQDITNYLNW YQQKPGKAPKLLIYDASNLEPGVPSRFSGSGSGTD FTFTISSLQPEDIATYYCQQYDDLFTFGPGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 376 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV ALTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 533 |
| iPS:361113 | 6A5.004.008 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATTTTGCAACATATTACTGTCA ACAGTATGATGATCTATTCACTTTCGGCCCTGGG ACCAAAGTGGATATCAAACGAACGGTGGCTGCA CCATCTGTCTTCATCTTCCCGCCATCTGATGAGC AGTTGAAATCTGGAACTGCCTCTGTTGTGTGCCT GCTGAATAACTTCTATCCCAGAGAGGCCAAAGT ACAGTGGAAGGTGGATAACGCCCTCCAATCGGG TAACTCCCAGGAGAGTGTCACAGAGCAGGACAG CAAGGACAGCACCTACAGCCTCAGCAGCACCCT GACGCTGAGCAAAGCAGACTACGAGAAACACA AAGTCTACGCCTGCGAAGTCACCCATCAGGGCC TGAGCTCGCCCGTCACAAAGAGCTTCAACAGGG GAGAGTGT SEQ ID NO: 1947 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGGAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC GTGATGCATGAGGCTCTGCACAACCACTACACG CAGAAGAGCCTCTCCCTGTCTCCGGGTAAA SEQ ID NO: 2104 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGPGTKVDIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 377 | QVQLVESGGGVVQPGRSLRLSCAASGFSFSSYGM HWVRQPPGKGLEWVAAIWYDGNNKYYADAVKG RFTISRDSSKNTLYLQMNSLRAEDTAVYYCARDR TIFGVVLEYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 534 |

Exemplary Light and Heavy Chain Nucleic Acid ("NA") and Amino Acid ("AA") Sequences TABLE 5-continued Exemplary Light and Heavy Chain Nucleic Acid ("NA") and Amino Acid ("AA") Sequences

| iPS# | Ab | Type | LC | HC |
|---|---|---|---|---|
| iPS:361120 | 6A5.004.009 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>AATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCCTGGG<br>ACCAAAGTGGATATCAAACGAACGGTGGCTGCA<br>CCATCTGTCTTCATCTTCCCGCCATCTGATGAGC<br>AGTTGAAATCTGGAACTGCCTCTGTTGTGTGCCT<br>GCTGAATAACTTCTATCCCAGAGAGGCCAAAGT<br>ACAGTGGAAGGTGGATAACGCCCTCCAATCGGG<br>TAACTCCCAGGAGAGTGTCACAGAGCAGGACAG<br>CAAGGACAGCACCTACAGCCTCAGCAGCACCCT<br>GACGCTGAGCAAAGCAGACTACGAGAAACACA<br>AAGTCTACGCCTGCGAAGTCACCCATCAGGGCC<br>TGAGCTCGCCCGTCACAAAGAGCTTCAACAGGG<br>GAGAGTGT<br>SEQ ID NO: 1948 | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACTCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2105 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGPGTKVDIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 378 | QVQLVESGGGVVQPGRSLRLSCAASGFSFSSYGM<br>HWVRQPPGKGLEWVAAIWYDANNKYYADSVKG<br>RFTISRDSSKNTLYLQMNSLRAEDTAVYYCARDR<br>TIFGVVLEYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 535 |
| iPS:359896 | 6A5.004.010 | NA | GACATCCAGATGACCCAGTCTCCATCCTCCCTGT<br>CTGCATCTGTGGGGGACAGAGTCACCATCACTT<br>GCCAGGCGAGTCAGGACATTACCAACTATTTAA<br>ATTGGTATCAGCAGAAACCAGGGAAAGCCCCTA<br>AACTCCTGATCTACGATGCTTCCAATTTGGAGCC<br>AGGGGTCCCATCAAGGTTCAGTGGAAGTGGATC<br>TGGGACAGATTTTACTCTCACCATCAGCAGCCT<br>GCAGCCTGAAGATTTTGCAACATATTACTGTCA<br>ACAGTATGATGATCTATTCACTTTCGGCCAAGG<br>GACCAAAGTGGATATCAAACGAACGGTGGCTGC<br>ACCATCTGTCTTCATCTTCCCGCCATCTGATGAG<br>CAGTTGAAATCTGGAACTGCCTCTGTTGTGTGCC<br>ATGCTGAATAACTTCTATCCCAGAGAGGCCAAAG<br>TACAGTGGAAGGTGGATAACGCCCTCCAATCGG<br>GTAACTCCCAGGAGAGTGTCACAGAGCAGGACA<br>GCAAGGACAGCACCTACAGCCTCAGCAGCACCC | CAGGTGCAGCTGGTGGAGTCTGGGGGAGGCGTG<br>GTCCAGCCTGGGAGGTCCCTGAGACTCTCCTGT<br>GCAGCGTCTGGATTCTCCTTCAGTAGCTATGGCA<br>TGCACTGGGTCCGCCAGCCTCCAGGCAAGGGGC<br>TGGAGTGGGTGGCAGCTATATGGTATGATGCAA<br>ATAATAAATACTATGCAGACGCCGTGAAGGGCC<br>GATTCACCATCTCCAGAGACAGTTCCAAGAACA<br>CGCTGTATCTGCAAATGAACAGCCTGAGAGCCG<br>AGGACACGGCTGTGTATTACTGTGCGAGAGATC<br>GGACGATTTTTGGAGTGGTCCTTGAGTACTGGG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TGACGCTGAGCAAAGCAGACTACGAGAAACAC AAAGTCTACGCCTGCGAAGTCACCCATCAGGGC CTGAGCTCGCCCGTCACAAAGAGCTTCAACAGG GGAGAGTGT SEQ ID NO: 1949 | TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC GTGATGCATGAGGCTCTGCACAACCACTACACG CAGAAGAGCCTCTCCCTGTCTCCGGGTAAA SEQ ID NO: 2106 |
| | | AA | DIQMTQSPSSLSASVGDRVTITCQASQDITNYLNW YQQKPGKAPKLLIYDASNLEPGVPSRFSGSGSGTD FTLTISSLQPEDFATYYCQQYDDLFTFGQGTKVDI KRTVAAPSVFIFPPSDEQLKSGTASVVCLLNNFYPR EAKVQWKVDNALQSGNSQESVTEQDSKDSTYSLS STLTLSKADYEKHKVYACEVTHQGLSSPVTKSFN RGEC SEQ ID NO: 379 | QVQLVESGGGVVQPGRSLRLSCAASGFSFSSYGM HWVRQPPGKGLEWVAAIWYDANNKYYADAVKG RFTISRDSSKNTLYLQMNSLRAEDTAVYYCARDR TIFGVVLEYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 536 |
| iPS:359890 | 6A5.004.011 | NA | GACATCCAGATGACCCAGTCTCCATCCTCCCTGT CTGCATCTGTGGGGGACAGAGTCACCATCACTT GCCAGGCGAGTCAGGACATTACCAACTATTTAA ATTGGTATCAGCAGAAACCAGGGAAAGCCCCTA AACTCCTGATCTACGATGCTTCCAATTTGGAGCC AGGGGTCCCATCAAGGTTCAGTGGAAGTGGATC TGGGACAGATTTTACTCTCACCATCAGCAGCCT GCAGCCTGAAGATTTTGCAACATATTACTGTCA ACAGTATGATGATCTATTCACTTTCGGCCAAGG GACCAAAGTGGATATCAAACGAACGGTGGCTGC ACCATCTGTCTTCATCTTCCCGCCATCTGATGAG CAGTTGAAATCTGGAACTGCCTCTGTTGTGTGCC TGCTGAATAACTTCTATCCCAGAGAGGCCAAAG TACAGTGGAAGGTGGATAACGCCCTCCAATCGG GTAACTCCCAGGAGAGTGTCACAGAGCAGGACA GCAAGGACAGCACCTACAGCCTCAGCAGCACCC TGACGCTGAGCAAAGCAGACTACGAGAAACAC AAAGTCTACGCCTGCGAAGTCACCCATCAGGGC CTGAGCTCGCCCGTCACAAAGAGCTTCAACAGG GGAGAGTGT SEQ ID NO: 1950 | CAGGTGCAGCTGGTGGAGTCTGGGGGAGGCGTG GTCCAGCCTGGGAGGTCCCTGAGACTCTCCTGT GCAGCGTCTGGATTCTCCTTCAGTAGCTATGGCA TGCACTGGGTCCGCCAGCCTCCAGGCAAGGGGC TGGAGTGGGTGGCAGCTATATGGTATGATGCAA ATAATAAATACTATGCAGACGCCGTGAAGGGCC GATTCACCATCTCCAGAGACAGTTCCAAGAACA CGCTGTATCTGCAAATGAACAGCCTGAGAGCCG AGGACACGGCTGTGTATTACTGTGCGAGAGATC GGACGATTTTTGGAGTGGTCCTTGAGTACCTCG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2107 |
| | | AA | DIQMTQSPSSLSASVGDRVTITCQASQDITNYLNW<br>YQQKPGKAPKLLIYDASNLEPGVPSRFSGSGSGTD<br>FTLTISSLQPEDFATYYCQQYDDLFTFGQGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 380 | QVQLVESGGGVVQPGRSLRLSCAASGFSFSSYGM<br>HWVRQPPGKGLEWVAAIWYDANNKYYADAVKG<br>RFTISRDSSKNTLYLQMNSLRAEDTAVYYCARDR<br>TIFGVVLEYLGQGTLVTVSSASTKGPSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV<br>KFNWYVDGVEVHNAKTKPCEEQYGSTYRCVSVL<br>TVLHQDWLNGKEYKCKVSNKALPAPIEKTISKAK<br>GQPREPQVYTLPPSREEMTKNQVSLTCLVKGFYPS<br>DIAVEWESNGQPENNYKTTPPVLDSDGSFFLYSKL<br>TVDKSRWQQGNVFSCSVMHEALHNHYTQKSLSL<br>SPGK<br>SEQ ID NO: 537 |
| iPS:359567 | 2A11.002 | NA | GAAATTGTGTTGACGCAGTCTCCAGGCACCCTG<br>TCTTTGTCTCCAGGGGAAAGAGCCACCCTCTCCT<br>GCAGGGCCAGTCAGATTTTTACCAGCACCTACT<br>TAGCCTGGTACCAGCAGAAACCTGGCCAGGCTC<br>CCAGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GATTGGAGCCTGAAGATTTTGCAGTGTATTACT<br>GTCAGCAGTATGGTAGCTCACCTCGCTTCGGCC<br>AAGGGACACGACTGGAGATTAAACGAACGGTG<br>GCTGCACCATCTGTCTTCATCTTCCCGCCATCTG<br>ATGAGCAGTTGAAATCTGGAACTGCCTCTGTTG<br>TGTGCCTGCTGAATAACTTCTATCCCAGAGAGG<br>CCAAAGTACAGTGGAAGGTGGATAACGCCCTCC<br>AATCGGGTAACTCCCAGGAGAGTGTCACAGAGC<br>AGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1951 | CAGGTGCAGCTGGTGGAGTCTGGGGGAGGCGTG<br>GTCCAGCCTGGGAGGTCCCTGAGACTCTCCTGT<br>GCAGCGTCTGGATTCAGTTTCAGTAGCTATGGC<br>ATGCACTGGGTCCGCCAGGCTCCAGGCAAGGGA<br>CTGGAGTGGGTGGCAGTTATATGGTATGATGCA<br>AGTAATAAATACTATGAAGACGCCGTGAAGGGC<br>CGATTCACCATCTCCAGAGACAATTCCAAGAAC<br>ACGCTGTTTCTGCAAGTGAACAGCCTGAGAGCC<br>GAGGACACGGCTGTGTATTACTGTGCGAGAGGG<br>ATTACGATTTTTGGTCATGGGTTTGAATATTGGG<br>GCCAGGGAACCCTGGTCACCGTCTCCTCAGCCT<br>CCACCAAGGGCCCATCGGTCTTCCCCCTGGCAC<br>CCTCCTCCAAGAGCACCTCTGGGGGCACAGCGG<br>CCCTGGGCTGCCTGGTCAAGGACTACTTCCCCG<br>AACCGGTGACGGTGTCGTGGAACTCAGGCGCCC<br>TGACCAGCGGCGTGCACACCTTCCCGGCTGTCC<br>TACAGTCCTCAGGACTCTACTCCCTCAGCAGCGT<br>GGTGACCGTGCCCTCCAGCAGCTTGGGCACCCA<br>GACCTACATCTGCAACGTGAATCACAAGCCCAG<br>CAACACCAAGGTGGACAAGAAAGTTGAGCCCA<br>AATCTTGTGACAAAACTCACACATGCCCACCGT<br>GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>ATCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2108 |
| | | AA | EIVLTQSPGTLSLSPGERATLSCRASQIFTSTYLAW<br>YQQKPGQAPRLLIYGASSRATGIPDRFSGSGSGTDF<br>TLTISRLEPEDFAVYYCQQYGSSPRFGQGTRLEIKR | QVQLVESGGGVVQPGRSLRLSCAASGFSFSSYGM<br>HWVRQAPGKGLEWVAVIWYDASNKYYEDAVKG<br>RFTISRDNSKNTLFLQVNSLRAEDTAVYYCARGITI |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 381 | FGHGFEYWGQGTLVTVSSASTKGPSVFPLAPSSKS TSGGTAALGCLVKDYFPEPVTVSWNSGALTSGVH TFPAVLQSSGLYSLSSVVTVPSSSLGTQTYICNVNH KPSNTKVDKKVEPKSCDKTHTCPPCPAPELLGGPS VFLFPPKPKDTLMISRTPEVTCVVVDVSHEDPEVK FNWYVDGVEVHNAKTKPCEEQYGSTYRCVSVLT VLHQDWLNGKEYKCKVSNKALPAPIEKTISKAKG QPREPQVYTLPPSREEMTKNQVSLTCLVKGFYPSD IAVEWESNGQPENNYKTTPPVLDSDGSFFLYSKLT VDKSRWQQGNVFSCSVMHEALHNHYTQKSLSLSP GK SEQ ID NO: 538 |
| iPS:335965 | 2A11.003 | NA | GAAATTGTGTTGACGCAGTCTCCAGGCACCCTG TCTTTGTCTCCAGGGGAAAGAGCCACCCTCTCCT GCAGGGCCAGTCAGATTTTTACCAGCACCTACT TAGCCTGGTACCAGCAGAAACCTGGCCAGGCTC CCAGGCTCCTCATCTATGGTGCATCCAGCAGGG CCACTGGCATCCCAGACAGGTTCAGTGGCAGTG GGTCTGGGACAGACTTCACTCTCACCATCAGCA GATTGGAGCCTGAAGATTTTGCAGTGTATTACT GTCAGCAGTATGGTAGCTCACCTCGCTTCGGCC AAGGGACACGACTGGAGATTAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1952 | CAGGTGCAGCTGGTGGAGTCTGGGGGAGGCGTG GTCCAGCCTGGGAGGTCCCTGAGACTCTCCTGT GCAGCGTCTGGATTCAGTTTCAGTAGCTATGGC ATGCACTGGGTCCGCCAGGCTCCAGGCAAGGGA CTGGAGTGGGTGGCAGTTATATGGTATGATGGA AGTAATAAATACTATGAAGACTCCGTGAAGGGC CGATTCACCATCTCCAGAGACAATTCCAAGAAC ACGCTGTTTCTGCAAGTGAACAGCCTGAGAGCC GAGGACACGGCTGTGTATTACTGTGCGAGAGGG ATTACGATTTTTGGTCATGGGTTTGAATATTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC AGTGATGCATGAGGCTCTGCACAACCACTACACG CAGAAGAGCCTCTCCCTGTCTCCGGGTAAA SEQ ID NO: 2109 |
| | | AA | EIVLTQSPGTLSLSPGERATLSCRASQIFTSTYL AWYQQKPGQAPRLLIYGASSRATGIPDRFSGSGS GTDFTLTISRLEPEDFAVYYCQQYGSSPRFGQGT RLEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC SEQ ID NO: 382 | QVQLVESGGGVVQPGRSLRLSCAASGFSFSSYGM HWVRQAPGKGLEWVAVIWYDGSNKYYEDSVKG RFTISRDNSKNTLFLQVNSLRAEDTAVYYCARGITI FGHGFEYWGQGTLVTVSSASTKGPSVFPLAPSSKS TSGGTAALGCLVKDYFPEPVTVSWNSGALTSGVH TFPAVLQSSGLYSLSSVVTVPSSSLGTQTYICNVNH KPSNTKVDKKVEPKSCDKTHTCPPCPAPELLGGPS VFLFPPKPKDTLMISRTPEVTCVVVDVSHEDPEVK FNWYVDGVEVHNAKTKPCEEQYGSTYRCVSVLT VLHQDWLNGKEYKCKVSNKALPAPIEKTISKAKG QPREPQVYTLPPSREEMTKNQVSLTCLVKGFYPSD IAVEWESNGQPENNYKTTPPVLDSDGSFFLYSKLT VDKSRWQQGNVFSCSVMHEALHNHYTQKSLSLSP GK SEQ ID NO: 539 |
| iPS:361158 | 2A11.004 | NA | GAAATTGTGTTGACGCAGTCTCCAGGCACCCTG TCTTTGTCTCCAGGGGAAAGAGCCACCCTCTCCT GCAGGGCCAGTCAGATTTTTACCAGCACCTACT TAGCCTGGTACCAGCAGAAACCTGGCCAGGCTC | CAGGTGCAGCTGGTGGAGTCTGGGGGAGGCGTG GTCCAGCCTGGGAGGTCCCTGAGACTCTCCTGT GCAGCGTCTGGATTCAGTTTCAGTAGCTATGGC ATGCACTGGGTCCGCCAGGCTCCAGGCAAGGGA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCAGGCTCCTCATCTATGGTGCATCCAGCAGGG CCACTGGCATCCCAGACAGGTTCAGTGGCAGTG GGTCTGGGACAGACTTCACTCTCACCATCAGCA GATTGGAGCCTGAAGATTTTGCAGTGTATTACT GTCAGCAGTATGGTAGCTCACCTCGCTTCGGCC AAGGGACACGACTGGAGATTAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1953 | CTGGAGTGGGTGGCAGTTATATGGTATGATGGA AGTAATAAATACTATGAAGACGCCGTGAAGGGC CGATTCACCATCTCCAGAGACAATTCCAAGAAC ACGCTGTTTCTGCAAGTGAACAGCCTGAGAGCC GAGGACACGGCTGTGTATTACTGTGCGAGAGGG ATTACGATTTTTGGTCATGGGTTTGAATATTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT GCCCAGCACCTGAACTCCTGGGGGGACCGTCAG TCTTCCTCTTCCCCCCAAAACCCAAGGACACCCT CATGATCTCCCGGACCCCTGAGGTCACATGCGT GGTGGTGGACGTGAGCCACGAAGACCCTGAGGT CAAGTTCAACTGGTACGTGGACGGCGTGGAGGT GCATAATGCCAAGACAAAGCCGTGTGAGGAGC AGTACGGCAGCACGTACCGTTGTGTCAGCGTCC TCACCGTCCTGCACCAGGACTGGCTGAATGGCA AGGAGTACAAGTGCAAGGTCTCCAACAAAGCCC TCCCAGCCCCCATCGAGAAAACCATCTCCAAAG CCAAAGGGCAGCCCCGAGAACCACAGGTGTAC ACCCTGCCCCCATCCCGGGAGGAGATGACCAAG AACCAGGTCAGCCTGACCTGCCTGGTCAAAGGC TTCTATCCCAGCGACATCGCCGTGGAGTGGGAG AGCAATGGGCAGCCGGAGAACAACTACAAGAC CACGCCTCCCGTGCTGGACTCCGACGGCTCCTTC TTCCTCTATAGCAAGCTCACCGTGGACAAGAGC AGGTGGCAGCAGGGGAACGTCTTCTCATGCTCC GTGATGCATGAGGCTCTGCACAACCACTACACG CAGAAGAGCCTCTCCCTGTCTCCGGGTAAA SEQ ID NO: 2110 |
| | | AA | EIVLTQSPGTLSLSPGERATLSCRASQIFTSTYLAW YQQKPGQAPRLLIYGASSRATGIPDRFSGSGSGTDF TLTISRLEPEDFAVYYCQQYGSSPRFGQGTRLEIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 383 | QVQLVESGGGVVQPGRSLRLSCAASGFSFSSYGM HWVRQAPGKGLEWVAVIWYDGSNKYYEDAVKG RFTISRDNSKNTLFLQVNSLRAEDTAVYYCARGITI FGHGFEYWGQGTLVTVSSASTKGPSVFPLAPSSKS ATSGGTAALGCLVKDYFPEPVTVSWNSGALTSGVH TFPAVLQSSGLYSLSSVVTVPSSSLGTQTYICNVNH KPSNTKVDKKVEPKSCDKTHTCPPCPAPELLGGPS VFLFPPKPKDTLMISRTPEVTCVVVDVSHEDPEVK FNWYVDGVEVHNAKTKPCEEQYGSTYRCVSVLT VLHQDWLNGKEYKCKVSNKALPAPIEKTISKAKG QPREPQVYTLPPSREEMTKNQVSLTCLVKGFYPSD IAVEWESNGQPENNYKTTPPVLDSDGSFFLYSKLT VDKSRWQQGNVFSCSVMHEALHNHYTQKSLSLSP GK SEQ ID NO: 540 |
| iPS:361165 | 2A11.005 | NA | GAAATTGTGTTGACGCAGTCTCCAGGCACCCTG TCTTTGTCTCCAGGGGAAAGAGCCACCCTCTCCT GCAGGGCCAGTCAGATTTTTACCAGCACCTACT TAGCCTGGTACCAGCAGAAACCTGGCCAGGCTC CCAGGCTCCTCATCTATGGTGCATCCAGCAGGG CCACTGGCATCCCAGACAGGTTCAGTGGCAGTG GGTCTGGGACAGACTTCACTCTCACCATCAGCA GATTGGAGCCTGAAGATTTTGCAGTGTATTACT GTCAGCAGTATGGTAGCTCACCTCGCTTCGGCC AAGGGACACGACTGGAGATTAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1954 | CAGGTGCAGCTGGTGGAGTCTGGGGGAGGCGTG GTCCAGCCTGGGAGGTCCCTGAGACTCTCCTGT GCAGCGTCTGGATTCAGTTTCAGTAGCTATGGC ATGCACTGGGTCCGCCAGGCTCCAGGCAAGGGA CTGGAGTGGGTGGCAGTTATATGGTATGATGCA AGTAATAAATACTATGAAGACTCCGTGAAGGGC CGATTCACCATCTCCAGAGACAATTCCAAGAAC ACGCTGTTTCTGCAAGTGAACAGCCTGAGAGCC GAGGACACGGCTGTGTATTACTGTGCGAGAGGG ATTACGATTTTTGGTCATGGGTTTGAATATTGGG GCCAGGGAACCCTGGTCACCGTCTCCTCAGCCT CCACCAAGGGCCCATCGGTCTTCCCCCTGGCAC CCTCCTCCAAGAGCACCTCTGGGGGCACAGCGG CCCTGGGCTGCCTGGTCAAGGACTACTTCCCCG AACCGGTGACGGTGTCGTGGAACTCAGGCGCCC TGACCAGCGGCGTGCACACCTTCCCGGCTGTCC TACAGTCCTCAGGACTCTACTCCCTCAGCAGCGT GGTGACCGTGCCCTCCAGCAGCTTGGGCACCCA GACCTACATCTGCAACGTGAATCACAAGCCCAG CAACACCAAGGTGGACAAGAAAGTTGAGCCCA AATCTTGTGACAAAACTCACACATGCCCACCGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCCCAGCACCTGAACTCCTGGGGGGACCGTCAG<br>TCTTCCTCTTCCCCCCAAAACCCAAGGACACCCT<br>CATGATCTCCCGGACCCCTGAGGTCACATGCGT<br>GGTGGTGGACGTGAGCCACGAAGACCCTGAGGT<br>CAAGTTCAACTGGTACGTGGACGGCGTGGAGGT<br>GCATAATGCCAAGACAAAGCCGTGTGAGGAGC<br>AGTACGGCAGCACGTACCGTTGTGTCAGCGTCC<br>TCACCGTCCTGCACCAGGACTGGCTGAATGGCA<br>AGGAGTACAAGTGCAAGGTCTCCAACAAAGCCC<br>TCCCAGCCCCCATCGAGAAAACCATCTCCAAAG<br>CCAAAGGGCAGCCCCGAGAACCACAGGTGTAC<br>ACCCTGCCCCCATCCCGGGAGGAGATGACCAAG<br>AACCAGGTCAGCCTGACCTGCCTGGTCAAAGGC<br>TTCTATCCCAGCGACATCGCCGTGGAGTGGGAG<br>AGCAATGGGCAGCCGGAGAACAACTACAAGAC<br>CACGCCTCCCGTGCTGGACTCCGACGGCTCCTTC<br>TTCCTCTATAGCAAGCTCACCGTGGACAAGAGC<br>AGGTGGCAGCAGGGGAACGTCTTCTCATGCTCC<br>GTGATGCATGAGGCTCTGCACAACCACTACACG<br>CAGAAGAGCCTCTCCCTGTCTCCGGGTAAA<br>SEQ ID NO: 2111 |
| | | AA | EIVLTQSPGTLSLSPGERATLSCRASQIFTSTYLAW<br>YQQKPGQAPRLLIYGASSRATGIPDRFSGSGSGTDF<br>TLTISRLEPEDFAVYYCQQYGSSPRFGQGTRLEIKR<br>TVAAPSVFIFPPSDEQLKSGTASVVCLLNNFYPREA<br>KVQWKVDNALQSGNSQESVTEQDSKDSTYSLSST<br>LTLSKADYEKHKVYACEVTHQGLSSPVTKSFNRG<br>EC<br>SEQ ID NO: 384 | QVQLVESGGGVVQPGRSLRLSCAASGFSFSSYGM<br>HWVRQAPGKGLEWVAVIWYDASNKYYEDSVKG<br>RFTISRDNSKNTLFLQVNSLRAEDTAVYYCARGITI<br>FGHGFEYWGQGTLVTVSSASTKGPSVFPLAPSSKS<br>TSGGTAALGCLVKDYFPEPVTVSWNSGALTSGVH<br>TFPAVLQSSGLYSLSSVVTVPSSSLGTQTYICNVNH<br>KPSNTKVDKKVEPKSCDKTHTCPPCPAPELLGGPS<br>VFLFPPKPKDTLMISRTPEVTCVVVDVSHEDPEVK<br>FNWYVDGVEVHNAKTKPCEEQYGSTYRCVSVLT<br>VLHQDWLNGKEYKCKVSNKALPAPIEKTISKAKG<br>QPREPQVYTLPPSREEMTKNQVSLTCLVKGFYPSD<br>IAVEWESNGQPENNYKTTPPVLDSDGSFFLYSKLT<br>VDKSRWQQGNVFSCSVMHEALHNHYTQKSLSLSP<br>GK<br>SEQ ID NO: 541 |
| iPS:361172 | 2G10_LC1.003 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGCAGTCTGAAGATTTTGCAGTTTATTACTGTC<br>AGCAGTATAATAACTGGCCTCTCACTTTCGGCG<br>GAGGGACCAAGGTGGAGATCAAACGAACGGTG<br>GCTGCACCATCTGTCTTCATCTTCCCGCCATCTG<br>ATGAGCAGTTGAAATCTGGAACTGCCTCTGTTG<br>TGTGCCTGCTGAATAACTTCTATCCCAGAGAGG<br>CCAAAGTACAGTGGAAGGTGGATAACGCCCTCC<br>AATCGGGTAACTCCCAGGAGAGTGTCACAGAGC<br>AGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1955 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCGAGGGG<br>CTGGAGTGGGTGGCAGCTATATGGTTTGATGCA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2112 |
| | | AA | EIVMTQSPATLSVSPGERATLSCRASQSVSSNLAW YQQKPGQAPRLLIYGAATRATGIPARFSGSGSGTE FTLTISSLQSEDFAVYYCQQYNNWPLTFGGGTKVE IKRTVAAPSVFIFPPSDEQLKSGTASVVCLLNNFYP REAKVQWKVDNALQSGNSQESVTEQDSKDSTYSL SSTLTLSKADYEKHKVYACEVTHQGLSSPVTKSFN RGEC SEQ ID NO: 385 | QVQLVESGGGVVQPGRSLRLSCAASGFTFSNYGM HWVRQAPGEGLEWVAAIWFDASDKYYADAVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 542 |
| iPS:361178 | 2G10_LC1.004 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC ACTGCAGTCTGAAGATTTTGCAGTTTATTACTGTC AGCAGTATAATAACTGGCCTCTCACTTTCGGCG GAGGGACCAAGGTGGAGATCAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1956 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG CTGGAGTGGGTGGCAGCTATATGGTTTGATGCA AGTGATAAATACTATGCAGACTCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2113 |
| | | AA | EIVMTQSPATLSVSPGERATLSCRASQSVSSNLAW YQQKPGQAPRLLIYGAATRATGIPARFSGSGSGTE FTLTISSLQSEDFAVYYCQQYNNWPLTFGGGTKVE IKRTVAAPSVFIFPPSDEQLKSGTASVVCLLNNFYP REAKVQWKVDNALQSGNSQESVTEQDSKDSTYSL SSTLTLSKADYEKHKVYACEVTHQGLSSPVTKSFN RGEC SEQ ID NO: 386 | QVQLVESGGGVVQPGRSLRLSCAASGFTFSNYGM HWVRQAPGEGLEWVAAIWFDASDKYYADSVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | LTVDKSRWQQGNVFSCSVMHEALHNHYTQKSLS LSPGK SEQ ID NO: 543 |
| iPS:361185 | 2G10_LC1.005 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGCAGTCTGAAGATTTTGCAGTTTATTACTGTC AGCAGTATAATAACTGGCCTCTCACTTTCGGCG GAGGGACCAAGGTGGAGATCAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1957 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG CTGGAGTGGGTGGCAGCTATATGGTTTGATGGA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2114 |
| | | AA | EIVMTQSPATLSVSPGERATLSCRASQSVSSNLAW YQQKPGQAPRLLIYGAATRATGIPARFSGSGSGTE FTLTISSLQSEDFAVYYCQQYNNWPLTFGGGTKVE IKRTVAAPSVFIFPPSDEQLKSGTASVVCLLNNFYP REAKVQWKVDNALQSGNSQESVTEQDSKDSTYSL SSTLTLSKADYEKHKVYACEVTHQGLSSPVTKSFN RGEC SEQ ID NO: 387 | QVQLVESGGGVVQPGRSLRLSCAASGFTFSNYGM HWVRQAPGEGLEWVAAIWFDGSDKYYADAVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 544 |
| iPS:361192 | 2G10_LC1.006 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGGTCAGTGGCAGTGGG TCTGGGACAGAGTTCACTCTCACCATCAGCAGC CTGCAGTCTGAAGATTTTGCAGTTTATTACTGTC AGCAGTATAATAACTGGCCTCTCACTTTCGGCG GAGGGACCAAGGTGGAGATCAAACGAACGGTG GCTGCACCATCTGTCTTCATCTTCCCGCCATCTG TCCACCAAGGGCCCATCGGTCTTCCCCCTGGCA TGTGCCTGCTGAATAACTTCTATCCCAGAGAGG | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC AATGAGCAGTTGAAATCTGGAACTGCCTCTGTTG CCCTCCTCCAAGAGCACCTCTGGGGGCACAGCG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCAAAGTACAGTGGAAGGTGGATAACGCCCTCC<br>AATCGGGTAACTCCCAGGAGAGTGTCACAGAGC<br>AGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1958 | GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2115 |
| | | AA | EIVMTQSPATLSVSPGERATLSCRASQSVSSNLAW<br>YQQKPGQAPRLLIYGAATRATGIPARVSGSGSGTE<br>FTLTISSLQSEDFAVYYCQQYNNWPLTFGGGTKVE<br>IKRTVAAPSVFIFPPSDEQLKSGTASVVCLLNNFYP<br>REAKVQWKVDNALQSGNSQESVTEQDSKDSTYSL<br>SSTLTLSKADYEKHKVYACEVTHQGLSSPVTKSFN<br>RGEC<br>SEQ ID NO: 388 | QVQLVESGGGVVQPGRSLRLSCAASGFTFSNYGM<br>HWVRQAPGEGLEWVAAIWFDASDKYYADAVKG<br>RFTISRDNSKNTLYLQMNSLRAEDTAVYYCARDQ<br>AIFGVVPDYWGQGTLVTVSSASTKGPSVFPLAPSS<br>KSTSGGTAALGCLVKDYFPEPVTVSWNSGALTSG<br>VHTFPAVLQSSGLYSLSSVVTVPSSSLGTQTYICNV<br>NHKPSNTKVDKKVEPKSCDKTHTCPPCPAPELLG<br>GPSVFLFPPKPKDTLMISRTPEVTCVVVDVSHEDPE<br>VKFNWYVDGVEVHNAKTKPCEEQYGSTYRCVSV<br>LTVLHQDWLNGKEYKCKVSNKALPAPIEKTISKA<br>KGQPREPQVYTLPPSREEMTKNQVSLTCLVKGFYP<br>SDIAVEWESNGQPENNYKTTPPVLDSDGSFFLYSK<br>LTVDKSRWQQGNVFSCSVMHEALHNHYTQKSLS<br>LSPGK<br>SEQ ID NO: 545 |
| iPS:359609 | 2G10_LC1.007 | NA | GAAATAGTGATGACGCAGTCTCCAGCCACCCTG<br>TCTGTGTCTCCAGGGGAAAGAGCCACCCTCTCC<br>TGCAGGGCCAGTCAGAGTGTTAGCAGCAACTTA<br>GCCTGGTACCAGCAGAAACCTGGCCAGGCTCCC<br>AGGCTCCTCATCTATGGTGCAGCCACCAGGGCC<br>ACTGGTATCCCAGCCAGGTTCAGTGGCAGTGGG<br>TCTGGGACAGAGTTCACTCTCACCATCAGCAGC<br>CTGGAGCCTGAAGATTTTGCAGTTTATTACTGTC<br>AGCAGTATAATAACTTCCCTCTCACTTTCGGCGG<br>AGGGACCAAGGTGGAGATCAAACGAACGGTGG<br>CTGCACCATCTGTCTTCATCTTCCCGCCATCTGA<br>TGAGCAGTTGAAATCTGGAACTGCCTCTGTTGT<br>GTGCCTGCTGAATAACTTCTATCCCAGAGAGGC<br>CAAAGTACAGTGGAAGGTGGATAACGCCCTCCA<br>ATCGGGTAACTCCCAGGAGAGTGTCACAGAGCA<br>GGACAGCAAGGACAGCACCTACAGCCTCAGCA<br>GCACCCTGACGCTGAGCAAAGCAGACTACGAGA<br>AACACAAAGTCTACGCCTGCGAAGTCACCCATC<br>AGGGCCTGAGCTCGCCCGTCACAAAGAGCTTCA<br>ACAGGGGAGAGTGT<br>SEQ ID NO: 1959 | CAGGTGCAGCTGGTGGAGTCTGGGGGAGGCGTG<br>GTCCAGCCTGGGAGGTCCCTGAGACTCTCCTGT<br>GCAGCATCTGGATTCACCTTCAGTAACTATGGC<br>ATGCACTGGGTCCGCCAGGCTCCAGGCAAGGGG<br>CTGGAGTGGGTGGCAGCTATATGGTTTGATGCA<br>AGTGATAAATACTATGCAGACGCCGTGAAGGGC<br>CGATTCACCATCTCCAGAGACAACTCCAAGAAC<br>ACGCTGTATCTGCAAATGAACAGCCTGAGAGCC<br>GAGGACACGGCTGTGTATTACTGTGCGAGAGAT<br>CAGGCGATTTTTGGAGTGGTCCCCGACTACTGG<br>GGCCAGGGAACCCTGGTCACCGTCTCCTCAGCC<br>TCCACCAAGGGCCCATCGGTCTTCCCCCTGGCA<br>CCCTCCTCCAAGAGCACCTCTGGGGGCACAGCG<br>GCCCTGGGCTGCCTGGTCAAGGACTACTTCCCC<br>GAACCGGTGACGGTGTCGTGGAACTCAGGCGCC<br>CTGACCAGCGGCGTGCACACCTTCCCGGCTGTC<br>CTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2116 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNFPLTFGGGTKVEI KRTVAAPSVFIFPPSDEQLKSGTASVVCLLNNFYPR EAKVQWKVDNALQSGNSQESVTEQDSKDSTYSLS STLTLSKADYEKHKVYACEVTHQGLSSPVTKSFN RGEC SEQ ID NO: 389 | QVQLVESGGGVVQPGRSLRLSCAASGFTFSNYGM HWVRQAPGKGLEWVAAIWFDASDKYYADAVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 546 |
| iPS:359615 | 2G10_LC1.008 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTATCCTCTCACTTTCGGCGG AGGGACCAAGGTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA AGGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 1960 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCAAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2117 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNYPLTFGGGTKVEI KRTVAAPSVFIFPPSDEQLKSGTASVVCLLNNFYPR | QVQLVESGGGVVQPGRSLRLSCAASGFTFSNYGM HWVRQAPGKGLEWVAAIWFDASDKYYADAVKG RFTISRDNSKNTLYLQMNSLRAEDTAVYYCARDQ AIFGVVPDYWGQGTLVTVSSASTKGPSVFPLAPSS |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | EAKVQWKVDNALQSGNSQESVTEQDSKDSTYSLS STLTLSKADYEKHKVYACEVTHQGLSSPVTKSFN RGEC SEQ ID NO: 390 | KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 547 |
| iPS:361196 | 2G10_LC1.009 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTGGCCTCTCACTTTCGGCG GAGGGACCAAGGTGGAGATCAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1961 | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCGAGGGG CTGGAGTGGGTGGCAGCTATATGGTTTGATGCA AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2118 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNWPLTFGGGTKVE IKRTVAAPSVFIFPPSDEQLKSGTASVVCLLNNFYP REAKVQWKVDNALQSGNSQESVTEQDSKDSTYSL SSTLTLSKADYEKHKVYACEVTHQGLSSPVTKSFN RGEC SEQ ID NO: 391 | QVQLVESGGGVVQPGRSLRLSCAASGFTFSNYGM HWVRQAPGEGLEWVAAIWFDASDKYYADAVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 548 |
| iPS:361202 | 2G10_LC1.010 | NA | GAAATAGTGATGACGCAGTCTCCAGCCACCCTG TCTGTGTCTCCAGGGGAAAGAGCCACCCTCTCC TGCAGGGCCAGTCAGAGTGTTAGCAGCAACTTA GCCTGGTACCAGCAGAAACCTGGCCAGGCTCCC AGGCTCCTCATCTATGGTGCAGCCACCAGGGCC | CAGGTGCAGCTGGTGGAGTCTGGGGGAGGCGTG GTCCAGCCTGGGAGGTCCCTGAGACTCTCCTGT GCAGCATCTGGATTCACCTTCAGTAACTATGGC ATGCACTGGGTCCGCCAGGCTCCAGGCAAGGGG CTGGAGTGGGTGGCAGCTATATGGTTTGATGCA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | ACTGGTATCCCAGCCAGGTTCAGTGGCAGTGGG TCTGGGACAGAGTTCACTCTCACCATCAGCAGC CTGGAGCCTGAAGATTTTGCAGTTTATTACTGTC AGCAGTATAATAACTGGCCTCTCACTTTCGGCG GAGGGACCAAGGTGGAGATCAAACGAACGGTG GCTGCACCATCTGTCTTCATCTTCCCGCCATCTG ATGAGCAGTTGAAATCTGGAACTGCCTCTGTTG TGTGCCTGCTGAATAACTTCTATCCCAGAGAGG CCAAAGTACAGTGGAAGGTGGATAACGCCCTCC AATCGGGTAACTCCCAGGAGAGTGTCACAGAGC AGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AAACAGGGGAGAGTGT SEQ ID NO: 1962 | AGTGATAAATACTATGCAGACGCCGTGAAGGGC CGATTCACCATCTCCAGAGACAACTCCAAGAAC ACGCTGTATCTGCAAATGAACAGCCTGAGAGCC GAGGACACGGCTGTGTATTACTGTGCGAGAGAT CAGGCGATTTTTGGAGTGGTCCCCGACTACTGG GGCCAGGGAACCCTGGTCACCGTCTCCTCAGCC TCCACCAAGGGCCCATCGGTCTTCCCCCTGGCA CCCTCCTCCAAGAGCACCTCTGGGGGCACAGCG GCCCTGGGCTGCCTGGTCAAGGACTACTTCCCC GAACCGGTGACGGTGTCGTGGAACTCAGGCGCC CTGACCAGCGGCGTGCACACCTTCCCGGCTGTC CTACAGTCCTCAGGACTCTACTCCCTCAGCAGC GTGGTGACCGTGCCCTCCAGCAGCTTGGGCACC CAGACCTACATCTGCAACGTGAATCACAAGCCC AGCAACACCAAGGTGGACAAGAAAGTTGAGCC CAAATCTTGTGACAAAACTCACACATGCCCACC GTGCCCAGCACCTGAACTCCTGGGGGGACCGTC AGTCTTCCTCTTCCCCCCAAAACCCAAGGACAC CCTCATGATCTCCCGGACCCCTGAGGTCACATG CGTGGTGGTGGACGTGAGCCACGAAGACCCTGA GGTCAAGTTCAACTGGTACGTGGACGGCGTGGA GGTGCATAATGCCAAGACAAAGCCGTGTGAGGA GCAGTACGGCAGCACGTACCGTTGTGTCAGCGT CCTCACCGTCCTGCACCAGGACTGGCTGAATGG CAAGGAGTACAAGTGCAAGGTCTCCAACAAAGC CCTCCCAGCCCCCATCGAGAAAACCATCTCCAA AGCCAAAGGGCAGCCCCGAGAACCACAGGTGT ACACCCTGCCCCCATCCCGGGAGGAGATGACCA AGAACCAGGTCAGCCTGACCTGCCTGGTCAAAG GCTTCTATCCCAGCGACATCGCCGTGGAGTGGG AGAGCAATGGGCAGCCGGAGAACAACTACAAG ACCACGCCTCCCGTGCTGGACTCCGACGGCTCC TTCTTCCTCTATAGCAAGCTCACCGTGGACAAG AGCAGGTGGCAGCAGGGGAACGTCTTCTCATGC TCCGTGATGCATGAGGCTCTGCACAACCACTAC ACGCAGAAGAGCCTCTCCCTGTCTCCGGGTAAA SEQ ID NO: 2119 |
| | | AA | EIVMTQSPATLSVSPGERATLSCRASQSVSSNLAW YQQKPGQAPRLLIYGAATRATGIPARFSGSGSGTE FTLTISSLEPEDFAVYYCQQYNNWPLTFGGGTKVE IKRTVAAPSVFIFPPSDEQLKSGTASVVCLLNNFYP REAKVQWKVDNALQSGNSQESVTEQDSKDSTYSL SSTLTLSKADYEKHKVYACEVTHQGLSSPVTKSFN RGEC SEQ ID NO: 392 | QVQLVESGGGVVQPGRSLRLSCAASGFTFSNYGM HWVRQAPGKGLEWVAAIWFDASDKYYADAVKG RFTISRDNSKNTLYLQMNSLRAEDTAVYYCARDQ AIFGVVPDYWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 549 |
| iPS:359644 | 18E3.002 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACTGGAGCCTGATGATTTTGCAGTGTATTACTG TCAGCAGTATGGTAGTTCACCGCTCACTTTCGGC GGAGGGACCAAGGTGGAGATCAAACGAACGGT GGCTGCACCATCTGTCTTCATCTTCCCGCCATCT GATGAGCAGTTGAAATCTGGAACTGCCTCTGTT GTGTGCCTGCTGAATAACTTCTATCCCAGAGAG GCCAAAGTACAGTGGAAGGTGGATAACGCCCTC CAATCGGGTAACTCCCAGGAGAGTGTCACAGAG CAGGACAGCAAGGACAGCACCTACAGCCTCAGC AGCACCCTGACGCTGAGCAAAGCAGACTACGAG AAACACAAAGTCTACGCCTGCGAAGTCACCCAT CAGGGCCTGAGCTCGCCCGTCACAAAGAGCTTC AACAGGGGAGAGTGT SEQ ID NO: 1963 | CAGGTGCAGTTGCAGGAGTCGGGCCCAGGACTG GTGAAGCCTTCAGAGACCCTGTCCCTCACCTGC ACTGTCTCTGGTGACTCCATCAGCAGTGGTGGTT ACTACTGGAGCTGGATCCGCCAGCCCCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCAGCCTCCACCAAGGGCCCATCG GTCTTCCCCCTGGCACCCTCCTCCAAGAGCACCT CTGGGGGCACAGCGGCCCTGGGCTGCCTGGTCA AGGACTACTTCCCCGAACCGGTGACGGTGTCGT GGAACTCAGGCGCCCTGACCAGCGGCGTGCACA CCTTCCCGGCTGTCCTACAGTCCTCAGGACTCTA CTCCCTCAGCAGCGTGGTGACCGTGCCCTCCAG CAGCTTGGGCACCCAGACCTACATCTGCAACGT GAATCACAAGCCCAGCAACACCAAGGTGGACA AGAAAGTTGAGCCCAAATCTTGTGACAAAACTC ACACATGCCCACCGTGCCCAGCACCTGAACTCC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | TGGGGGGACCGTCAGTCTTCCTCTTCCCCCCAAA<br>ACCCAAGGACACCCTCATGATCTCCCGGACCCC<br>TGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2120 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 393 | QVQLQESGPGLVKPSETLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 550 |
| iPS:361206 | 18E3.003 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACAGGAGCCTGATGATTTTGCAGTGTATTACT<br>GTCAGCAGTATGGTAGTTCACCGCTCACTTTCGG<br>CGGAGGGACCAAGGTGGAGATCAAACGAACGG<br>TGGCTGCACCATCTGTCTTCATCTTCCCGCCATC<br>TGATGAGCAGTTGAAATCTGGAACTGCCTCTGT<br>TGTGTGCCTGCTGAATAACTTCTATCCCAGAGA<br>GGCCAAAGTACAGTGGAAGGTGGATAACGCCCT<br>CCAATCGGGTAACTCCCAGGAGAGTGTCACAGA<br>GCAGGACAGCAAGGACAGCACCTACAGCCTCA<br>GCAGCACCCTGACGCTGAGCAAAGCAGACTACG<br>AGAAACACAAAGTCTACGCCTGCGAAGTCACCC<br>ATCAGGGCCTGAGCTCGCCCGTCACAAAGAGCT<br>TCAACAGGGGAGAGTGT<br>SEQ ID NO: 1964 | CAGGTGCAGTTGCAGGAGTCGGGCCCAGGACTG<br>GTGAAGCCTTCAGAGACCCTGTCCCTCACCTGC<br>ACTGTCTCTGGTGACTCCATCAGCAGTGGTGGTT<br>ACTACTGGAGCTGGATCCGCCAGCCCCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCAGCCTCCACCAAGGGCCCATCG<br>GTCTTCCCCCTGGCACCCTCCTCCAAGAGCACCT<br>CTGGGGGCACAGCGGCCCTGGGCTGCCTGGTCA<br>AGGACTACTTCCCCGAACCGGTGACGGTGTCGT<br>GGAACTCAGGCGCCCTGACCAGCGGCGTGCACA<br>CCTTCCCGGCTGTCCTACAGTCCTCAGGACTCTA<br>CTCCCTCAGCAGCGTGGTGACCGTGCCCTCCAG<br>CAGCTTGGGCACCCAGACCTACATCTGCAACGT<br>GAATCACAAGCCCAGCAACACCAAGGTGGACA<br>AGAAAGTTGAGCCCAAATCTTGTGACAAAACTC<br>ACACATGCCCACCGTGCCCAGCACCTGAACTCC<br>ATGGGGGGACCGTCAGTCTTCCTCTTCCCCCCAAA<br>ACCCAAGGACACCCTCATGATCTCCCGGACCCC<br>TGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2121 |
| | | AA | EIVLTQSPGTLSLSPGERATLSCRASQSISYSYLAW<br>YQQKPGQAPRLLIYGASSRATGIPDRFSGSGSGTDF<br>TLTISRQEPDDFAVYYCQQYGSSPLTFGGGTKVEI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 394 | QVQLQESGPGLVKPSETLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 551 |
| iPS:359628 | 18E3.004 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGAACGGT<br>GGCTGCACCATCTGTCTTCATCTTCCCGCCATCT<br>GATGAGCAGTTGAAATCTGGAACTGCCTCTGTT<br>GTGTGCCTGCTGAATAACTTCTATCCCAGAGAG<br>GCCAAAGTACAGTGGAAGGTGGATAACGCCCTC<br>CAATCGGGTAACTCCCAGGAGAGTGTCACAGAG<br>CAGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1965 | CAGGTGCAGTTGCAGGAGTCGGGCCCAGGACTG<br>GTGAAGCCTTCACAGACCCTGTCCCTCACCTGC<br>ACTGTCTCTGGTGACTCCATCAGCAGTGGTGGTT<br>ACTACTGGAGCTGGATCCGCCAGCCCCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCAGCCTCCACCAAGGGCCCATCG<br>GTCTTCCCCCTGGCACCCTCCTCCAAGAGCACCT<br>CTGGGGGCACAGCGGCCCTGGGCTGCCTGGTCA<br>AGGACTACTTCCCCGAACCGGTGACGGTGTCGT<br>GGAACTCAGGCGCCCTGACCAGCGGCGTGCACA<br>CCTTCCCGGCTGTCCTACAGTCCTCAGGACTCTA<br>CTCCCTCAGCAGCGTGGTGACCGTGCCCTCCAG<br>CAGCTTGGGCACCCAGACCTACATCTGCAACGT<br>GAATCACAAGCCCAGCAACACCAAGGTGGACA<br>AGAAAGTTGAGCCCAAATCTTGTGACAAAACTC<br>ACACATGCCCACCGTGCCCAGCACCTGAACTCC<br>TGGGGGGACCGTCAGTCTTCCTCTTCCCCCCAAA<br>ACCCAAGGACACCCTCATGATCTCCCGGACCCC<br>TGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2122 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 395 | QVQLQESGPGLVKPSQTLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 552 |
| iPS:359637 | 18E3.005 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGAACGGT<br>GGCTGCACCATCTGTCTTCATCTTCCCGCCATCT<br>GATGAGCAGTTGAAATCTGGAACTGCCTCTGTT<br>GTGTGCCTGCTGAATAACTTCTATCCCAGAGAG<br>GCCAAAGTACAGTGGAAGGTGGATAACGCCCTC<br>CAATCGGGTAACTCCCAGGAGAGTGTCACAGAG<br>CAGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1966 | CAGGTGCAGTTGCAGGAGTCGGGCCCAGGACTG<br>GTGAAGCCTTCAGAGACCCTGTCCCTCACCTGC<br>ACTGTCTCTGGTGACTCCATCAGCAGTGGTGGTT<br>ACTACTGGAGCTGGATCCGCCAGCACCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCAGCCTCCACCAAGGGCCCATCG<br>GTCTTCCCCCTGGCACCCTCCTCCAAGAGCACCT<br>CTGGGGGCACAGCGGCCCTGGGCTGCCTGGTCA<br>AGGACTACTTCCCCGAACCGGTGACGGTGTCGT<br>GGAACTCAGGCGCCCTGACCAGCGGCGTGCACA<br>CCTTCCCGGCTGTCCTACAGTCCTCAGGACTCTA<br>CTCCCTCAGCAGCGTGGTGACCGTGCCCTCCAG<br>CAGCTTGGGCACCCAGACCTACATCTGCAACGT<br>GAATCACAAGCCCAGCAACACCAAGGTGGACA<br>AGAAAGTTGAGCCCAAATCTTGTGACAAAACTC<br>ACACATGCCCACCGTGCCCAGCACCTGAACTCC<br>TGGGGGGACCGTCAGTCTTCCTCTTCCCCCCAAA<br>ACCCAAGGACACCCTCATGATCTCCCGGACCCC<br>ATGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2123 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 396 | QVQLQESGPGLVKPSETLSLTCTVSGDSISSGGYY<br>WSWIRQHPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 553 |
| iPS:361210 | 18E3.006 | NA | GAAATTGTGTTGACGCAGTCTCCAGGCACCCTG<br>TCTTTGTCTCCAGGGGAAAGAGCCACCCTCTCCT | CAGGTGCAGTTGCAGGAGTCGGGCCCAGGACTG<br>GTGAAGCCTTCACAGACCCTGTCCCTCACCTGC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGATGATTTTGCAGTGTATTACTG<br>TCAGCAGTATGGTAGTTCACCGCTCACTTTCGGC<br>GGAGGGACCAAGGTGGAGATCAAACGAACGGT<br>GGCTGCACCATCTGTCTTCATCTTCCCGCCATCT<br>GATGAGCAGTTGAAATCTGGAACTGCCTCTGTT<br>GTGTGCCTGCTGAATAACTTCTATCCCAGAGAG<br>GCCAAAGTACAGTGGAAGGTGGATAACGCCCTC<br>CAATCGGGTAACTCCCAGGAGAGTGTCACAGAG<br>CAGGACAGCAAGGACAGCACCTACAGCCTCAGC<br>AGCACCCTGACGCTGAGCAAAGCAGACTACGAG<br>AAACACAAAGTCTACGCCTGCGAAGTCACCCAT<br>CAGGGCCTGAGCTCGCCCGTCACAAAGAGCTTC<br>AACAGGGGAGAGTGT<br>SEQ ID NO: 1967 | ACTGTCTCTGGTGACTCCATCAGCAGTGGTGGTT<br>ACTACTGGAGCTGGATCCGCCAGCACCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCAGCCTCCACCAAGGGCCCATCG<br>GTCTTCCCCCTGGCACCCTCCTCCAAGAGCACCT<br>CTGGGGGCACAGCGGCCCTGGGCTGCCTGGTCA<br>AGGACTACTTCCCCGAACCGGTGACGGTGTCGT<br>GGAACTCAGGCGCCCTGACCAGCGGCGTGCACA<br>CCTTCCCGGCTGTCCTACAGTCCTCAGGACTCTA<br>CTCCCTCAGCAGCGTGGTGACCGTGCCCTCCAG<br>CAGCTTGGGCACCCAGACCTACATCTGCAACGT<br>GAATCACAAGCCCAGCAACACCAAGGTGGACA<br>AGAAAGTTGAGCCCAAATCTTGTGACAAAACTC<br>ACACATGCCCACCGTGCCCAGCACCTGAACTCC<br>TGGGGGGACCGTCAGTCTTCCTCTTCCCCCCAAA<br>ACCCAAGGACACCCTCATGATCTCCCGGACCCC<br>TGAGGTCACATGCGTGGTGGTGGACGTGAGCCA<br>CGAAGACCCTGAGGTCAAGTTCAACTGGTACGT<br>GGACGGCGTGGAGGTGCATAATGCCAAGACAA<br>AGCCGTGTGAGGAGCAGTACGGCAGCACGTACC<br>GTTGTGTCAGCGTCCTCACCGTCCTGCACCAGG<br>ACTGGCTGAATGGCAAGGAGTACAAGTGCAAG<br>GTCTCCAACAAAGCCCTCCCAGCCCCCATCGAG<br>AAAACCATCTCCAAAGCCAAAGGGCAGCCCCGA<br>GAACCACAGGTGTACACCCTGCCCCCATCCCGG<br>GAGGAGATGACCAAGAACCAGGTCAGCCTGAC<br>CTGCCTGGTCAAAGGCTTCTATCCCAGCGACAT<br>CGCCGTGGAGTGGGAGAGCAATGGGCAGCCGG<br>AGAACAACTACAAGACCACGCCTCCCGTGCTGG<br>ACTCCGACGGCTCCTTCTTCCTCTATAGCAAGCT<br>CACCGTGGACAAGAGCAGGTGGCAGCAGGGGA<br>ACGTCTTCTCATGCTCCGTGATGCATGAGGCTCT<br>GCACAACCACTACACGCAGAAGAGCCTCTCCCT<br>GTCTCCGGGTAAA<br>SEQ ID NO: 2124 |
| | | AA | EIVLTQSPGTLSLSPGERATLSCRASQSISYSYLAW<br>YQQKPGQAPRLLIYGASSRATGIPDRFSGSGSGTDF<br>TLTISRLEPDDFAVYYCQQYGSSPLTFGGGTKVEIK<br>RTVAAPSVFIFPPSDEQLKSGTASVVCLLNNFYPRE<br>AKVQWKVDNALQSGNSQESVTEQDSKDSTYSLSS<br>TLTLSKADYEKHKVYACEVTHQGLSSPVTKSFNR<br>GEC<br>SEQ ID NO: 397 | QVQLQESGPGLVKPSQTLSLTCTVSGDSISSGGYY<br>WSWIRQHPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 554 |
| iPS:361214 | 18E3.007 | NA | GAAATTGTGTTGACGCAGTCTCCAGGCACCCTG<br>TCTTTGTCTCCAGGGGAAAGAGCCACCCTCTCCT<br>GCAGGGCCAGTCAGAGTATTAGTTACAGTTACT<br>TAGCCTGGTACCAGCAGAAACCTGGCCAGGCTC<br>CCCGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACAGGAGCCTGATGATTTTGCAGTGTATTACT<br>GTCAGCAGTATGGTAGTTCACCGCTCACTTTCGG<br>CGGAGGGACCAAGGTGGAGATCAAACGAACGG<br>TGGCTGCACCATCTGTCTTCATCTTCCCGCCATC<br>TGATGAGCAGTTGAAATCTGGAACTGCCTCTGT<br>TGTGTGCCTGCTGAATAACTTCTATCCCAGAGA<br>GGCCAAAGTACAGTGGAAGGTGGATAACGCCCT<br>CCAATCGGGTAACTCCCAGGAGAGTGTCACAGA<br>GCAGGACAGCAAGGACAGCACCTACAGCCTCA<br>GCAGCACCCTGACGCTGAGCAAAGCAGACTACG<br>AGAAACACAAAGTCTACGCCTGCGAAGTCACCC | CAGGTGCAGTTGCAGGAGTCGGGCCCAGGACTG<br>GTGAAGCCTTCAGAGACCCTGTCCCTCACCTGC<br>ACTGTCTCTGGTGACTCCATCAGCAGTGGTGGTT<br>ACTACTGGAGCTGGATCCGCCAGCACCCAGGGA<br>AGGGCCTGGAGTGGATTGGGTACATCTATTACA<br>GTGGGAGCACCTACTACAACCCGTCCCTCAAGA<br>GTCGAGTTACCATATCAGTAGACACGTCTAAGA<br>ACCAGTTCTCCCTGAAGCTGAGCTCTGTGACTGC<br>CGCGGACACGGCCGTGTATTACTGTGCGAGAGA<br>TCGTATTACGATTTTTGGAGTGGTTATGGGGGGC<br>GGTATGGACGTCTGGGGCCAAGGGACCACGGTC<br>ACCGTCTCCTCAGCCTCCACCAAGGGCCCATCG<br>GTCTTCCCCCTGGCACCCTCCTCCAAGAGCACCT<br>CTGGGGGCACAGCGGCCCTGGGCTGCCTGGTCA<br>AGGACTACTTCCCCGAACCGGTGACGGTGTCGT<br>GGAACTCAGGCGCCCTGACCAGCGGCGTGCACA<br>CCTTCCCGGCTGTCCTACAGTCCTCAGGACTCTA<br>CTCCCTCAGCAGCGTGGTGACCGTGCCCTCCAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | AATCAGGGCCTGAGCTCGCCCGTCACAAAGAGCT TCAACAGGGGAGAGTGT SEQ ID NO: 1968 | CAGCTTGGGCACCCAGACCTACATCTGCAACGT GAATCACAAGCCCAGCAACACCAAGGTGGACA AGAAAGTTGAGCCCAAATCTTGTGACAAAACTC ACACATGCCCACCGTGCCCAGCACCTGAACTCC TGGGGGGACCGTCAGTCTTCCTCTTCCCCCCAAA ACCCAAGGACACCCTCATGATCTCCCGGACCCC TGAGGTCACATGCGTGGTGGTGGACGTGAGCCA CGAAGACCCTGAGGTCAAGTTCAACTGGTACGT GGACGGCGTGGAGGTGCATAATGCCAAGACAA AGCCGTGTGAGGAGCAGTACGGCAGCACGTACC GTTGTGTCAGCGTCCTCACCGTCCTGCACCAGG ACTGGCTGAATGGCAAGGAGTACAAGTGCAAG GTCTCCAACAAAGCCCTCCCAGCCCCCATCGAG AAAACCATCTCCAAAGCCAAAGGGCAGCCCCGA GAACCACAGGTGTACACCCTGCCCCCATCCCGG GAGGAGATGACCAAGAACCAGGTCAGCCTGAC CTGCCTGGTCAAAGGCTTCTATCCCAGCGACAT CGCCGTGGAGTGGGAGAGCAATGGGCAGCCGG AGAACAACTACAAGACCACGCCTCCCGTGCTGG ACTCCGACGGCTCCTTCTTCCTCTATAGCAAGCT CACCGTGGACAAGAGCAGGTGGCAGCAGGGGA ACGTCTTCTCATGCTCCGTGATGCATGAGGCTCT GCACAACCACTACACGCAGAAGAGCCTCTCCCT SEQ ID NO: 2125 |
| | | AA | EIVLTQSPGTLSLSPGERATLSCRASQSISYSYLAW YQQKPGQAPRLLIYGASSRATGIPDRFSGSGSGTDF TLTISRQEPDDFAVYYCQQYGSSPLTFGGGTKVEI KRTVAAPSVFIFPPSDEQLKSGTASVVCLLNNFYPR EAKVQWKVDNALQSGNSQESVTEQDSKDSTYSLS STLTLSKADYEKHKVYACEVTHQGLSSPVTKSFN RGEC SEQ ID NO: 398 | QVQLQESGPGLVKPSETLSLTCTVSGDSISSGGYY WSWIRQHPGKGLEWIGYIYYSGSTYYNPSLKSRVT ISVDTSKNQFSLKLSSVTAADTAVYYCARDRITIFG VVMGGGMDVWGQGTTVTVSSASTKGPSVFPLAP SSKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 555 |
| iPS:361218 | 18E3.008 | NA | GAAATTGTGTTGACGCAGTCTCCAGGCACCCTG TCTTTGTCTCCAGGGGAAAGAGCCACCCTCTCCT GCAGGGCCAGTCAGAGTATTAGTTACAGTTACT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACAGGAGCCTGATGATTTTGCAGTGTATTACT GTCAGCAGTATGGTAGTTCACCGCTCACTTTCGG CGGAGGGACCAAGGTGGAGATCAAACGAACGG TGGCTGCACCATCTGTCTTCATCTTCCCGCCATC TGATGAGCAGTTGAAATCTGGAACTGCCTCTGT TGTGTGCCTGCTGAATAACTTCTATCCCAGAGA GGCCAAAGTACAGTGGAAGGTGGATAACGCCCT CCAATCGGGTAACTCCCAGGAGAGTGTCACAGA GCAGGACAGCAAGGACAGCACCTACAGCCTCA GCAGCACCCTGACGCTGAGCAAAGCAGACTACG AGAAACACAAAGTCTACGCCTGCGAAGTCACCC ATCAGGGCCTGAGCTCGCCCGTCACAAAGAGCT TCAACAGGGGAGAGTGT SEQ ID NO: 1969 | CAGGTGCAGTTGCAGGAGTCGGGCCCAGGACTG GTGAAGCCTTCACAGACCCTGTCCCTCACCTGC ACTGTCTCTGGTGACTCCATCAGCAGTGGTGGTT ACTACTGGAGCTGGATCCGCCAGCCCCCAGGGA AGGGCCTGGAGTGGATTGGGTACATCTATTACA GTGGGAGCACCTACTACAACCCGTCCCTCAAGA GTCGAGTTACCATATCAGTAGACACGTCTAAGA ACCAGTTCTCCCTGAAGCTGAGCTCTGTGACTGC CGCGGACACGGCCGTGTATTACTGTGCGAGAGA TCGTATTACGATTTTTGGAGTGGTTATGGGGGGC GGTATGGACGTCTGGGGCCAAGGGACCACGGTC ACCGTCTCCTCAGCCTCCACCAAGGGCCCATCG GTCTTCCCCCTGGCACCCTCCTCCAAGAGCACCT CTGGGGGCACAGCGGCCCTGGGCTGCCTGGTCA AGGACTACTTCCCCGAACCGGTGACGGTGTCGT GGAACTCAGGCGCCCTGACCAGCGGCGTGCACA CCTTCCCGGCTGTCCTACAGTCCTCAGGACTCTA CTCCCTCAGCAGCGTGGTGACCGTGCCCTCCAG CAGCTTGGGCACCCAGACCTACATCTGCAACGT GAATCACAAGCCCAGCAACACCAAGGTGGACA AGAAAGTTGAGCCCAAATCTTGTGACAAAACTC ACACATGCCCACCGTGCCCAGCACCTGAACTCC TGGGGGGACCGTCAGTCTTCCTCTTCCCCCCAAA ACCCAAGGACACCCTCATGATCTCCCGGACCCC TGAGGTCACATGCGTGGTGGTGGACGTGAGCCA CGAAGACCCTGAGGTCAAGTTCAACTGGTACGT GGACGGCGTGGAGGTGCATAATGCCAAGACAA AGCCGTGTGAGGAGCAGTACGGCAGCACGTACC GTTGTGTCAGCGTCCTCACCGTCCTGCACCAGG ACTGGCTGAATGGCAAGGAGTACAAGTGCAAG GTCTCCAACAAAGCCCTCCCAGCCCCCATCGAG AAAACCATCTCCAAAGCCAAAGGGCAGCCCCGA SEQ ID NO: 2126 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | AA | EIVLTQSPGTLSLSPGERATLSCRASQSISYSYLAW<br>YQQKPGQAPRLLIYGASSRATGIPDRFSGSGSGTDF<br>TLTISRQEPDDFAVYYCQQYGSSPLTFGGGTKVEI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 399 | QVQLQESGPGLVKPSQTLSLTCTVSGDSISSGGYY<br>WSWIRQPPGKGLEWIGYIYYSGSTYYNPSLKSRVT<br>ISVDTSKNQFSLKLSSVTAADTAVYYCARDRITIFG<br>VVMGGGMDVWGQGTTVTVSSASTKGPSVFPLAP<br>SSKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 556 |
| iPS:361222 | 5C2.006 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGAACGGTGGCTGCACCATCTGTCTT<br>CATCTTCCCGCCATCTGATGAGCAGTTGAAATCT<br>GGAACTGCCTCTGTTGTGTGCCTGCTGAATAACT<br>TCTATCCCAGAGAGGCCAAAGTACAGTGGAAGG<br>TGGATAACGCCCTCCAATCGGGTAACTCCCAGG<br>AGAGTGTCACAGAGCAGGACAGCAAGGACAGC<br>ACCTACAGCCTCAGCAGCACCCTGACGCTGAGC<br>AAAGCAGACTACGAGAAACACAAAGTCTACGC<br>CTGCGAAGTCACCCATCAGGGCCTGAGCTCGCC<br>CGTCACAAAGAGCTTCAACAGGGGAGAGTGT<br>SEQ ID NO: 1970 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGAAAGT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>ATCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2127 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKRTVAAPSVFIFPPSDEQLKSGTASVVCLL<br>NNFYPREAKVQWKVDNALQSGNSQESVTEQDSK<br>DSTYSLSSTLTLSKADYEKHKVYACEVTHQGLSSP<br>VTKSFNRGEC<br>SEQ ID NO: 400 | QVQLVQSGAEVKKPGASVKVSCKASGYTFTGYYI<br>HWVRQAPGQGLEWMGWINPESGGTDYSQRFQGR<br>VTMTRDTSISTAYMELNRLRSDDTAVYYCAREATI<br>FGMVIVPFDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 557 |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| iPS:361229 | 5C2.007 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGAACGGTGGCTGCACCATCTGTCTT<br>CATCTTCCCGCCATCTGATGAGCAGTTGAAATCT<br>GGAACTGCCTCTGTTGTGTGCCTGCTGAATAACT<br>TCTATCCCAGAGAGGCCAAAGTACAGTGGAAGG<br>TGGATAACGCCCTCCAATCGGGTAACTCCCAGG<br>AGAGTGTCACAGAGCAGGACAGCAAGGACAGC<br>ACCTACAGCCTCAGCAGCACCCTGACGCTGAGC<br>AAAGCAGACTACGAGAAACACAAAGTCTACGC<br>CTGCGAAGTCACCCATCAGGGCCTGAGCTCGCC<br>CGTCACAAAGAGCTTCAACAGGGGAGAGTGT<br>SEQ ID NO: 1971 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGAAAGT<br>GGTGGCACAGACTATTCACAGAGGTTTCAGGGC<br>AGGTTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2128 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKRTVAAPSVFIFPPSDEQLKSGTASVVCLL<br>NNFYPREAKVQWKVDNALQSGNSQESVTEQDSK<br>DSTYSLSSTLTLSKADYEKHKVYACEVTHQGLSSP<br>VTKSFNRGEC<br>SEQ ID NO: 401 | QVPLVQSGAEVKKPGASVKVSCKASGYTFTGYYI<br>HWVRQAPGQGLEWMGWINPESGGTDYSQRFQGR<br>FTMTRDTSISTAYMELNRLRSDDTAVYYCAREATI<br>FGMVIVPFDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 558 |
| iPS:361236 | 5C2.008 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGAACGGTGGCTGCACCATCTGTCTT<br>CATCTTCCCGCCATCTGATGAGCAGTTGAAATCT<br>GGAACTGCCTCTGTTGTGTGCCTGCTGAATAACT<br>TCTATCCCAGAGAGGCCAAAGTACAGTGGAAGG<br>TGGATAACGCCCTCCAATCGGGTAACTCCCAGG | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACGCT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1972 | AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT AGACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2129 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 402 | QVQLVQSGAEVKKPGASVKVSCKASGYTFTGYYI HWVRQAPGQGLEWMGWINPDAGGTDYSQRFQG RVTMTRDTSISTAYMELNRLRSDDTAVYYCAREA TIFGMVIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 559 |
| iPS:359685 | 5C2.009 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1973 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACGCT GGTGGCACAGACTATTCACAGAGGTTTCAGGGC AGGTTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2130 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ<br>GTKVEIKRTVAAPSVFIFPPSDEQLKSGTASVVCLL<br>NNFYPREAKVQWKVDNALQSGNSQESVTEQDSK<br>DSTYSLSSTLTLSKADYEKHKVYACEVTHQGLSSP<br>VTKSFNRGEC<br>SEQ ID NO: 403 | QVPLVQSGAEVKKPGASVKVSCKASGYTFTGYYI<br>HWVRQAPGQGLEWMGWINPDAGGTDYSQRFQG<br>RFTMTRDTSISTAYMELNRLRSDDTAVYYCAREA<br>TIFGMVIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 560 |
| iPS:361240 | 5C2.010 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>CAACCAGGACATCCTCCTAAGCTGCTCATTTACT<br>GGGCATCTACCCGGGAATCCGGGGTCCCTGACC<br>GATTCAGTGGCAGCGGGTCTGGGACAGATTTCA<br>CTCTCACCATCAGCAGCCTGCAGGCTGAAGATG<br>TGGCAGTTTTTTACTGTCAACAATATTATAGTAC<br>TCCGTGGACGTTCGGCCAAGGGACCAAGGTGGA<br>AATCAAACGAACGGTGGCTGCACCATCTGTCTT<br>CATCTTCCCGCCATCTGATGAGCAGTTGAAATCT<br>GGAACTGCCTCTGTTGTGTGCCTGCTGAATAACT<br>TCTATCCCAGAGAGGCCAAAGTACAGTGGAAGG<br>TGGATAACGCCCTCCAATCGGGTAACTCCCAGG<br>AGAGTGTCACAGAGCAGGACAGCAAGGACAGC<br>ACCTACAGCCTCAGCAGCACCCTGACGCTGAGC<br>AAAGCAGACTACGAGAAACACAAAGTCTACGC<br>CTGCGAAGTCACCCATCAGGGCCTGAGCTCGCC<br>CGTCACAAAGAGCTTCAACAGGGGAGAGTGT<br>SEQ ID NO: 1974 | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGG<br>CTTGAGTGGATGGGGTGGATCAACCCTGACAGT<br>GGTGGCACAGACTATTCACAGAGGTTTCAGGGC<br>AGGGTCACCATGACCAGGGACACGTCCATCAGC<br>ACAGCCTACATGGAACTGAACAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>ACAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2131 |
| | | AA | DIVMTQSPDSLAVSLGERATINCKSSQSVLSSSNNK<br>NYIAWYQQQPGHPPKLLIYWASTRESGVPDRFSGS<br>GSGTDFTLTISSLQAEDVAVFYCQQYYSTPWTFGQ | QVQLVQSGAEVKKPGASVKVSCKASGYTFTGYYI<br>HWVRQAPGQGLEWMGWINPDSGGTDYSQRFQGR<br>VTMTRDTSISTAYMELNRLRSDDTAVYYCAREATI |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 404 | FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 561 |
| iPS:361247 | 5C2.011 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1975 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACAGT GGTGGCACAGACTATTCACAGAGGTTTCAGGGC AGGTTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2132 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 405 | QVQLVQSGAEVKKPGASVKVSCKASGYTFTGYYI HWVRQAPGQGLEWMGWINPDSGGTDYSQRFQGR FTMTRDTSISTAYMELNRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 562 |
| iPS:361254 | 5C2.012 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT |

TABLE 5-continued

| iPS# | Ab | Type | LC | HC |
|---|---|---|---|---|
| | | | AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1976 | ATCCACTGGGTGCGACAGGCCCCTGGACAAGGG CTTGAGTGGATGGGGTGGATCAACCCTGACAGT GGTGGCACAGACTATTCACAGAGGTTTCAGGGC AGGGTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT AACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2133 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 406 | QVPLVQSGAEVKKPGASVKVSCKASGYTFTGYYI HWVRQAPGQGLEWMGWINPDSGGTDYSQRFQGR VTMTRDTSISTAYMELNRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 563 |
| iPS:361261 | 5C2.013 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACGCT GGTGGCACAGACTATTCACAGAGGTTTCAGGGC AGGTTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC |

TABLE 5-continued

| iPS# | Ab | Type | LC | HC |
|---|---|---|---|---|
| | | | AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1977 | AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2134 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 407 | QVQLVQSGAEVKKPGASVKVSCKASGYTFTGYYI HWVRQAPGQGLEWMGWINPDAGGTDYSQRFQG RFTMTRDTSISTAYMELNRLRSDDTAVYYCAREA TIFGMVIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 564 |
| iPS:361268 | 5C2.014 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG CAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1978 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACGCT GGTGGCACAGACTATTCACAGAGGTTTCAGGGC AGGGTCACCATGACCAGGGACACGTCCATCAGC ACAGCCTACATGGAACTGAACAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG AGCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2135 |
| | | AA | DIVMTQSPDSLAVSLGERATINCKSSQSVLSSSNNK NYIAWYQQQPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 408 | QVPLVQSGAEVKKPGASVKVSCKASGYTFTGYYI HWVRQAPGQGLEWMGWINPDAGGTDYSQRFQG RVTMTRDTSISTAYMELNRLRSDDTAVYYCAREA TIFGMVIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 565 |
| iPS:359669 | 5C2.015 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACAACCTCCTAAGCTGCTCATTTAC TGGGCATCTACCCGGGAATCCGGGGTCCCTGAC CGATTCAGTGGCAGCGGGTCTGGGACAGATTTC ACTCTCACCATCAGCAGCCTGCAGGCTGAAGAT GTGGCAGTTTTTTACTGTCAACAATATTATAGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1979 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGACGCT GGTGGCACAGACTATTCACAGAGGTTTCAGGGC AGGGTCACCATGACCAGGGACACGTCCATCAGC ACAGCCTACATGGAACTGAACAGCCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2136 |
| | | AA | DIVMTQSPDSLAVSLGERATINCKSSQSVLSSSNNK NYIAWYQQKPGQPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL | QVQLVQSGAEVKKPGASVKVSCKASGYTFTGYYI HWVRQAPGQGLEWMGWINPDAGGTDYSQRFQG RVTMTRDTSISTAYMELNSLRSDDTAVYYCAREA TIFGMVIVPFDYWGQGTLVTVSSASTKGPSVFPLA |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | NNFYPREAKVQWKVDNALQSGNSQESVTEQDSK DSTYSLSSTLTLSKADYEKHKVYACEVTHQGLSSP VTKSFNRGEC SEQ ID NO: 409 | PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 566 |
| iPS:359678 | 5C2.016 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACAACCTCCTAAGCTGCTCATTTAC TGGGCATCTACCCGGGAATCCGGGGTCCCTGAC CGATTCAGTGGCAGCGGGTCTGGGACAGATTTC ACTCTCACCATCAGCAGCCTGCAGGCTGAAGAT GTGGCAGTTTTTTACTGTCAACAATATTATAGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1980 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGG CTTGAGTGGATGGGGTGGATCAACCCTGAAAGT GGTGGCACAGACTATTCACAGAGGTTTCAGGGC AGGGTCACCATGACCAGGGACACGTCCATCAGC ACAGCCTACATGGAACTGAACAGCCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC AATGCTCCGTGATGCATGAGGCTCTGCACAACCA CTACACGCAGAAGAGCCTCTCCCTGTCTCCGGG TAAA SEQ ID NO: 2137 |
| | | AA | DIVMTQSPDSLAVSLGERATINCKSSQSVLSSSNNK NYIAWYQQKPGQPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 410 | QVQLVQSGAEVKKPGASVKVSCKASGYTFTGYYI HWVRQAPGQGLEWMGWINPESGGTDYSQRFQGR VTMTRDTSISTAYMELNSLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 567 |
| iPS:361275 | 11C1.002 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1981 | CTTGTGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2138 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 411 | QVPLVQSGAEVKKPGASVKVSCKASGYTFTGYYI HWVRQAPGQGLVWMGWISPNSGETSYAQKFQDR VTMTRDTSISTAYMELSRLRSDDTAVYFCAREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 568 |
| iPS:361282 | 11C1.003 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGACACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCTGCGAAGTCACCCATCAGGGCCTGAGCTCGC CCGTCACAAAGAGCTTCAACAGGGGAGAGTGT SEQ ID NO: 1982 | GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG ATAAA SEQ ID NO: 2139 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 412 | QVPLVQSGAEVKKPGASVKVSCKASGYTFTGYYI HWVRQAPGQGLVWMGWISPNSGDTSYAQKFQDR VTMTRDTSISTAYMELSRLRSDDTAVYFCAREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 569 |
| iPS:361289 | 11C1.004 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1983 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2140 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 413 | QVPLVQSGAEVKKPGASVKVSCKASGYTFTGYYI HWVRQAPGQGLVWMGWISPNSGETSYAQKFQDR VTMTRDTSISTAYMELSRLRSDDTAVYFCAREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 570 |
| iPS:359712 | 11C1.005 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1984 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTACGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2141 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKRTVAAPSVFIFPPSDEQLKSGTASVVC | VPLVQSGAEVKKPGASVKVSCKASGYTFTGYYI HWVRQAPGQGLVWMGWISPNSGETSYAQKFQDR VTMTRDTSISTAYMELSRLRSDDTAVYFCTREATI FGMLIVPFDYWGQGTLVTVSSASTKGPSVFPLAPS |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | LLNNFYPREAKVQWKVDNALQSGNSQESVTEQDS KDSTYSLSSTLTLSKADYEKHKVYACEVTHQGLSS PVTKSFNRGEC SEQ ID NO: 414 | SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 571 |
| iPS:361293 | 11C1.006 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1985 | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGACACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTACGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2142 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 415 | QVPLVQSGAEVKKPGASVKVSCKASGYTFTGYYI HWVRQAPGQGLVWMGWISPNSGDTSYAQKFQDR VTMTRDTSISTAYMELSRLRSDDTAVYFCTREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 572 |
| iPS:361297 | 11C1.007 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1986 | CTTGTGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTACGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2143 |
| | | AA | DIVMTQSPDSLSVSLGERATINCKSSQSVLSSSNNK NYLAWYQQKPGQPPNLLIYWTSTRDSGVPDRFSG ASGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 416 | QVPLVQSGAEVKKPGASVKVSCKASGYTFTGYYI HWVRQAPGQGLVWMGWISPNSGETSYAQKFQDR VTMTRDTSISTAYMELSRLRSDDTAVYFCTREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 573 |
| iPS:361301 | 11C1.008 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG | CAGGTGCCGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGTGTGGATGGGGTGGATCAGCCCTAACAGT GGTGACACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CCTGCGAAGTCACCCATCAGGGCCTGAGCTCGC<br>CCGTCACAAAGAGCTTCAACAGGGGAGAGTGT<br>SEQ ID NO: 1987 | GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2144 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 417 | QVPLVQSGAEVKKPGASVKVSCKASGYTFTGYYI<br>HWVRQAPGQGLVWMGWISPNSGDTSYAQKFQDR<br>VTMTRDTSISTAYMELSRLRSDDTAVYFCAREATI<br>FGMLIVPFDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 574 |
| iPS:359703 | 11C1.009 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAACAG<br>AAACCAGGACAGCCTCCTAAACTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 1988 | CAGGTGCAGCTGGTACAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATCAGCCCTAACAGT<br>GGTGAAACAAGCTATGCACAGAAGTTTCAGGAC<br>AGGGTCACCATGACCAGGGACACGTCCATCAGC<br>ACAGCCTATATGGAGCTGAGCAGCCTGAGATCT<br>GACGACACGGCCGTGTATTTCTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2145 |
| | | AA | DIVMTQSPDSLAVSLGERATINCKSSQSVLSSSNNK NYLAWYQQKPGQPPKLLIYWTSTRESGVPDRFSG SGSGTDFTLTINSLQAEDVAVYYCQQYYRTPWTF GQGTKVEIKRTVAAPSVFIFPPSDEQLKSGTASVVC ALLNNFYPREAKVQWKVDNALQSGNSQESVTEQDS KDSTYSLSSTLTLSKADYEKHKVYACEVTHQGLSS PVTKSFNRGEC SEQ ID NO: 418 | QVQLVQSGAEVKKPGASVKVSCKASGYTFTGYYI HWVRQAPGQGLEWMGWISPNSGETSYAQKFQDR VTMTRDTSISTAYMELSSLRSDDTAVYFCAREATI FGMLIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 575 |
| iPS:361305 | 11C1.010 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAACAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1989 | CAGGTGCAGCTGGTACAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATCAGCCCTAACAGT GGTGAAACAAGCTATGCACAGAAGTTTCAGGAC AGGGTCACCATGACCAGGGACACGTCCATCAGC ACAGCCTATATGGAGCTGAGCAGACTGAGATCT GACGACACGGCCGTGTATTTCTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2146 |
| | | AA | DIVMTQSPDSLSVSLGERATINCKSSQSVLSSSNNK NYLAWYQQKPGQPPNLLIYWTSTRESGVPDRFSG SGSGTDFTLTINSLQAEDVAVYYCQQYYRTPWTF GQGTKVEIKRTVAAPSVFIFPPSDEQLKSGTASVVC | QVQLVQSGAEVKKPGASVKVSCKASGYTFTGYYI HWVRQAPGQGLEWMGWISPNSGETSYAQKFQDR VTMTRDTSISTAYMELSRLRSDDTAVYFCAREATI FGMLIVPFDYWGQGTLVTVSSASTKGPSVFPLAPS |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | LLNNFYPREAKVQWKVDNALQSGNSQESVTEQDS KDSTYSLSSTLTLSKADYEKHKVYACEVTHQGLSS PVTKSFNRGEC SEQ ID NO: 419 | SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 576 |
| iPS:361312 | 13H12.002 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1990 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGA CTTGAGTGGATGGGGTGGATCAACCCTGAAAGT GGTGGCACAGACTATTCACAGAGGTTTCAGGGC AGGGTCACCATGACCAGGGACACGTCCATCAGC ACAGCCTACATGGAACTGAGCAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2147 |
| | | AA | DIVMTQSPDSLAVSLGERATINCKSSQSVLSSSNNK NYIAWYQQKPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP AVTKSFNRGEC SEQ ID NO: 420 | QVPLVQSGAEVKKPGASVKVSCKASGYTFTGYYI HWVRQAPGQGLEWMGWINPESGGTDYSQRFQGR VTMTRDTSISTAYMELSRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 577 |
| iPS:359744 | 13H12.003 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGA |

TABLE 5-continued

| iPS# | Ab | Type | LC | HC |
|---|---|---|---|---|
| | | | AAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1991 | CTTGAGTGGATGGGGTGGATCAACCCTGAAAGT GGTGGCACAGACTATTCACAGAGGTTTCAGGGC AGGTTCACCATGACCAGGGACACGTCCATCAGC ACAGCCTACATGGAACTGAGCAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2148 |
| | | AA | DIVMTQSPDSLAVSLGERATINCKSSQSVLSSSNNK NYIAWYQQKPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGECVNHKP SEQ ID NO: 421 | QVPLVQSGAEVKKPGASVKVSCKASGYTFTGYYI HWVRQAPGQGLEWMGWINPESGGTDYSQRFQGR FTMTRDTSISTAYMELSRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN SNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 578 |
| iPS:361319 | 13H12.004 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACATCCTCCTAAGCTGCTCATTTACT GGGCATCTACCCGGGAATCCGGGGTCCCTGACC GATTCAGTGGCAGCGGGTCTGGGACAGATTTCA CTCTCACCATCAGCAGCCTGCAGGCTGAAGATG TGGCAGTTTTTTACTGTCAACAATATTATAGTAC TCCGTGGACGTTCGGCCAAGGGACCAAGGTGGA AATCAAACGAACGGTGGCTGCACCATCTGTCTT CATCTTCCCGCCATCTGATGAGCAGTTGAAATCT GGAACTGCCTCTGTTGTGTGCCTGCTGAATAACT TCTATCCCAGAGAGGCCAAAGTACAGTGGAAGG TGGATAACGCCCTCCAATCGGGTAACTCCCAGG AGAGTGTCACAGAGCAGGACAGCAAGGACAGC ACCTACAGCCTCAGCAGCACCCTGACGCTGAGC | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGA CTTGAGTGGATGGGGTGGATCAACCCTGACAGT GGTGGCACAGACTATTCACAGAGGTTTCAGGGC AGGGTCACCATGACCAGGGACACGTCCATCAGC ACAGCCTACATGGAACTGAGCAGGCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | AAAGCAGACTACGAGAAACACAAAGTCTACGC CTGCGAAGTCACCCATCAGGGCCTGAGCTCGCC CGTCACAAAGAGCTTCAACAGGGGAGAGTGT SEQ ID NO: 1992 | AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2149 |
| | | AA | DIVMTQSPDSLAVSLGERATINCKSSQSVLSSSNNK NYIAWYQQKPGHPPKLLIYWASTRESGVPDRFSGS GSGTDFTLTISSLQAEDVAVFYCQQYYSTPWTFGQ GTKVEIKRTVAAPSVFIFPPSDEQLKSGTASVVCLL NNFYPREAKVQWKVDNALQSGNSQESVTEQDSK DSTYSLSSTLTLSKADYEKHKVYACEVTHQGLSSP VTKSFNRGEC SEQ ID NO: 422 | QVPLVQSGAEVKKPGASVKVSCKASGYTFTGYYI HWVRQAPGQGLEWMGWINPDSGGTDYSQRFQGR VTMTRDTSISTAYMELSRLRSDDTAVYYCAREATI FGMVIVPFDYWGQGTLVTVSSASTKGPSVFPLAPS SKSTSGGTAALGCLVKDYFPEPVTVSWNSGALTS GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED APEVKFNWYVDGVEVHNAKTKPCEEQYGSTYRCV SVLTVLHQDWLNGKEYKCKVSNKALPAPIEKTISK AKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 579 |
| iPS:359737 | 13H12.005 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACATAGCTTGGTACCAGCAG AAACCAGGACAACCTCCTAAGCTGCTCATTTAC TGGGCATCTACCCGGGAATCCGGGGTCCCTGAC CGATTCAGTGGCAGCGGGTCTGGGACAGATTTC ACTCTCACCATCAGCAGCCTGCAGGCTGAAGAT GTGGCAGTTTTTTACTGTCAACAATATTATAGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1993 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATCCACTGGGTGCGACAGGCCCCTGGACAAGGA CTTGAGTGGATGGGGTGGATCAACCCTGAAAGT GGTGGCACAGACTATTCACAGAGGTTTCAGGGC AGGGTCACCATGACCAGGGACACGTCCATCAGC ACAGCCTACATGGAACTGAGCAGCCTGAGATCT GACGACACGGCCGTGTATTACTGTGCGAGAGAG GCCACGATTTTTGGAATGGTTATTGTACCGTTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2150 |
| | | AA | DIVMTQSPDSLAVSLGERATINCKSSQSVLSSSNNK<br>NYIAWYQQKPGQPPKLLIYWASTRESGVPDRFSGS<br>GSGTDFTLTISSLQAEDVAVFYCQQYYSTPWTFGQ<br>GTKVEIKRTVAAPSVFIFPPSDEQLKSGTASVVCLL<br>NNFYPREAKVQWKVDNALQSGNSQESVTEQDSK<br>DSTYSLSSTLTLSKADYEKHKVYACEVTHQGLSSP<br>VTKSFNRGEC<br>SEQ ID NO: 423 | QVQLVQSGAEVKKPGASVKVSCKASGYTFTGYYI<br>HWVRQAPGQGLEWMGWINPESGGTDYSQRFQGR<br>VTMTRDTSISTAYMELSSLRSDDTAVYYCAREATI<br>FGMVIVPFDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 580 |
| iPS:361326 | 13H12.006 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACATAGCTTGGTACCAGCAG<br>AAACCAGGACAACCTCCTAAGCTGCTCATTTAC<br>TGGGCATCTACCCGGGAATCCGGGGTCCCTGAC<br>CGATTCAGTGGCAGCGGGTCTGGGACAGATTTC<br>ACTCTCACCATCAGCAGCCTGCAGGCTGAAGAT<br>GTGGCAGTTTTTTACTGTCAACAATATTATAGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 1994 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATCCACTGGGTGCGACAGGCCCCTGGACAAGGA<br>CTTGAGTGGATGGGGTGGATCAACCCTGAAAGT<br>GGTGGCACAGACTATTCACAGAGGTTTCAGGGC<br>AGGGTCACCATGACCAGGGACACGTCCATCAGC<br>ACAGCCTACATGGAACTGAGCAGGCTGAGATCT<br>GACGACACGGCCGTGTATTACTGTGCGAGAGAG<br>GCCACGATTTTTGGAATGGTTATTGTACCGTTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2151 |
| | | AA | DIVMTQSPDSLAVSLGERATINCKSSQSVLSSSNNK<br>NYIAWYQQKPGQPPKLLIYWASTRESGVPDRFSGS<br>GSGTDFTLTISSLQAEDVAVFYCQQYYSTPWTFGQ<br>GTKVEIKRTVAAPSVFIFPPSDEQLKSGTASVVCLL<br>NNFYPREAKVQWKVDNALQSGNSQESVTEQDSK | QVPLVQSGAEVKKPGASVKVSCKASGYTFTGYYI<br>HWVRQAPGQGLEWMGWINPESGGTDYSQRFQGR<br>VTMTRDTSISTAYMELSRLRSDDTAVYYCAREATI<br>FGMVIVPFDYWGQGTLVTVSSASTKGPSVFPLAPS<br>SKSTSGGTAALGCLVKDYFPEPVTVSWNSGALTS |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | DSTYSLSSTLTLSKADYEKHKVYACEVTHQGLSSP VTKSFNRGEC SEQ ID NO: 424 | GVHTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHED PEVKFNWYVDGVEVHNAKTKPCEEQYGSTYRCV SVLTVLHQDWLNGKEYKCKVSNKALPAPIEKTISK AAKGQPREPQVYTLPPSREEMTKNQVSLTCLVKGF YPSDIAVEWESNGQPENNYKTTPPVLDSDGSFFLY SKLTVDKSRWQQGNVFSCSVMHEALHNHYTQKS LSLSPGK SEQ ID NO: 581 |
| iPS:361330 | 12H11.002 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1995 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2152 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 425 | QVPLVQSGAEVKKPGASVKVSCKASGYTFTGYYI HWVRQAPGQGLEWMGWISPNQGETNYAQKFQD RVTMTRDTSISTAYMELSRLRSDDTAVYYCAREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 582 |
| iPS:361337 | 12H11.003 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 1996 | GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2153 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 426 | QVPLVQSGAEVKKPGASVKVSCKASGYTFTGYYI<br>HWVRQAPGQGLEWMGWISPNQGDTNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>AYSKLTVDKSRWQQGNVFSCSVMHEALHNHYTQK<br>SLSLSPGK<br>SEQ ID NO: 583 |
| iPS:361344 | 12H11.004 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 1997 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGAAACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTACGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2154 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 427 | QVPLVQSGAEVKKPGASVKVSCKASGYTFTGYYI HWVRQAPGQGLEWMGWISPNQGETNYAQKFQD RVTMTRDTSISTAYMELSRLRSDDTAVYYCTREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 584 |
| iPS:361351 | 12H11.005 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 1998 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2155 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 428 | QVPLVQSGAEVKKPGASVKVSCKASGYTFTGYYI<br>HWVRQAPGQGLEWMGWISPNNGETNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 585 |
| iPS:361358 | 12H11.006 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 1999 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACAAT<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2156 |
| | | AA | DIVMTQSPDSLSVSLGERATINCKSSQSVLSSSNNK<br>NYLAWYQQKPGQPPNLLIYWTSTRDSGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 429 | QVPLVQSGAEVKKPGASVKVSCKASGYTFTGYYI<br>HWVRQAPGQGLEWMGWISPNNGDTNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 586 |
| iPS:361365 | 12H11.007 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 2000 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGACACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTACGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2157 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 430 | QVPLVQSGAEVKKPGASVKVSCKASGYTFTGYYI HWVRQAPGQGLEWMGWISPNQGDTNYAQKFQD RVTMTRDTSISTAYMELSRLRSDDTAVYYCTREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 587 |
| iPS:361372 | 12H11.008 | NA | GACATCGTGATGACCCAGTCTCCAGACTCCCTG ATCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGATCAGCCTCCTAACCTGCTCATTTAC TGGACTTCTACCCGAGATTCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACAAT GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTACGAGAGAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 2001 | GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2158 |
| | | AA | DIVMTQSPDSLSVSLGERATINCKSSQSVLSSSNNK NYLAWYQQKPGQPPNLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 431 | QVPLVQSGAEVKKPGASVKVSCKASGYTFTGYYI HWVRQAPGQGLEWMGWISPNNGETNYAQKFQD RVTMTRDTSISTAYMELSRLRSDDTAVYYCTREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 588 |
| iPS:361379 | 12H11.009 | NA | GACATCGTGATGACCCAGTCTCCAGACTCCCTG TCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAACCTGCTCATTTAC TGGACTTCTACCCGAGAATCCGGGGTCCCTGAC CGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 2002 | CAGGTGCCGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGGCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2159 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGECNVNHKP<br>SEQ ID NO: 432 | QVPLVQSGAEVKKPGASVKVSCKASGYTFTGYYI<br>HWVRQAPGQGLEWMGWISPNQGETNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 589 |
| iPS:361383 | 12H11.010 | NA | GACATCGTGATGACCCAGTCTCCAGACTCCCTG<br>TCTGTGTCTCTGGGCGAGAGGGCCACCATCAAC<br>ATGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 2003 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACAAT<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA |

TABLE 5-continued

Exemplary Light and Heavy Chain Nucleic Acid (“NA”) and Amino Acid (“AA”) Sequences

| iPS# | Ab | Type | LC | HC |
|---|---|---|---|---|
| | | | | CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2160 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 433 | QVPLVQSGAEVKKPGASVKVSCKASGYTFTGYYI<br>HWVRQAPGQGLEWMGWISPNNGDTNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 590 |
| iPS:361387 | 12H11.011 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 2004 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGACACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2161 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 434 | QVPLVQSGAEVKKPGASVKVSCKASGYTFTGYYI<br>HWVRQAPGQGLEWMGWISPNQGDTNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 591 |
| iPS:361391 | 12H11.012 | NA | GACATCGTGATGACCCAGTCTCCAGACTCCCTG<br>TCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAAACCAGGACAGCCTCCTAACCTGCTCATTTAC<br>TGGACTTCTACCCGAGAATCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG<br>AAATCAAACGAACGGTGGCTGCACCATCTGTCT<br>TCATCTTCCCGCCATCTGATGAGCAGTTGAAATC<br>TGGAACTGCCTCTGTTGTGTGCCTGCTGAATAAC<br>TTCTATCCCAGAGAGGCCAAAGTACAGTGGAAG<br>GTGGATAACGCCCTCCAATCGGGTAACTCCCAG<br>GAGAGTGTCACAGAGCAGGACAGCAAGGACAG<br>CACCTACAGCCTCAGCAGCACCCTGACGCTGAG<br>CAAAGCAGACTACGAGAAACACAAAGTCTACG<br>CCTGCGAAGTCACCCATCAGGGCCTGAGCTCGC<br>CCGTCACAAAGAGCTTCAACAGGGGAGAGTGT<br>SEQ ID NO: 2005 | CAGGTGCCGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACAAT<br>GGTGAAACAAACTATGCACAGAAGTTTCAGGAC<br>AGGGTCACCATGACCAGGGACACGTCCATCAGC<br>ACAGCCTATATGGAGCTGAGCAGGCTGAGATCT<br>GACGACACGGCCGTGTATTACTGTGCGAGAGAG<br>GCCACGATTTTTGGAATGCTTATTGTACCATTTG<br>ACTACTGGGGCCAGGGAACCCTGGTCACCGTCT<br>CCTCAGCCTCCACCAAGGGCCCATCGGTCTTCCC<br>CCTGGCACCCTCCTCCAAGAGCACCTCTGGGGG<br>CACAGCGGCCCTGGGCTGCCTGGTCAAGGACTA<br>CTTCCCCGAACCGGTGACGGTGTCGTGGAACTC<br>AGGCGCCCTGACCAGCGGCGTGCACACCTTCCC<br>GGCTGTCCTACAGTCCTCAGGACTCTACTCCCTC<br>AGCAGCGTGGTGACCGTGCCCTCCAGCAGCTTG<br>GGCACCCAGACCTACATCTGCAACGTGAATCAC<br>AAGCCCAGCAACACCAAGGTGGACAAGAAAGT<br>TGAGCCCAAATCTTGTGACAAAACTCACACATG<br>CCCACCGTGCCCAGCACCTGAACTCCTGGGGGG<br>ACCGTCAGTCTTCCTCTTCCCCCCAAAACCCAAG<br>GACACCCTCATGATCTCCCGGACCCCTGAGGTC<br>ACATGCGTGGTGGTGGACGTGAGCCACGAAGAC<br>CCTGAGGTCAAGTTCAACTGGTACGTGGACGGC<br>GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2162 |
| | | AA | DIVMTQSPDSLSVSLGERATINCKSSQSVLSSSNNK<br>NYLAWYQQKPGQPPNLLIYWTSTRESGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 435 | QVPLVQSGAEVKKPGASVKVSCKASGYTFTGYYI<br>HWVRQAPGQGLEWMGWISPNNGETNYAQKFQD<br>RVTMTRDTSISTAYMELSRLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 592 |
| iPS:361395 | 12H11.013 | NA | GACATCGTGATGACCCAGTCTCCAGACTCCCTG<br>GCTGTGTCTCTGGGCGAGAGGGCCACCATCAAC<br>TGCAAGTCCAGCCAGAGTGTTTTATCCAGCTCC<br>AACAATAAGAACTACTTAGCTTGGTACCAGCAG<br>AAACCAGGACAGCCTCCTAAACTGCTCATTTAC<br>TGGACTTCTACCCGAGATTCCGGGGTCCCTGAC<br>CGATTCAGTGGCAGCGGGTCTGGGACAGATTTC<br>ACTCTCACCATCAACAGCCTGCAGGCTGAAGAT<br>GTGGCTGTTTATTACTGTCAGCAATATTATCGTA<br>CTCCGTGGACGTTCGGCCAAGGGACCAAGGTGG | CAGGTGCAGCTGGTGCAGTCTGGGGCTGAGGTG<br>AAGAAGCCTGGGGCCTCAGTGAAGGTCTCCTGC<br>AAGGCTTCTGGATACACCTTCACCGGCTACTAT<br>ATACACTGGGTGCGTCAGGCCCCTGGACAAGGG<br>CTTGAGTGGATGGGGTGGATAAGCCCTAACCAA<br>GGTGAAACAAACTATGCACAGAAGTTTCAGGAC<br>AGGGTCACCATGACCAGGGACACGTCCATCAGC<br>ACAGCCTATATGGAGCTGAGCAGCCTGAGATCT<br>GACGACACGGCCGTGTATTACTGTGCGAGAGAG<br>GCCACGATTTTTGGAATGCTTATTGTACCATTTG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 2006 | ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC GTGGAGGTGCATAATGCCAAGACAAAGCCGTGT GAGGAGCAGTACGGCAGCACGTACCGTTGTGTC AGCGTCCTCACCGTCCTGCACCAGGACTGGCTG AATGGCAAGGAGTACAAGTGCAAGGTCTCCAAC AAAGCCCTCCCAGCCCCCATCGAGAAAACCATC TCCAAAGCCAAAGGGCAGCCCCGAGAACCACA GGTGTACACCCTGCCCCCATCCCGGGAGGAGAT GACCAAGAACCAGGTCAGCCTGACCTGCCTGGT CAAAGGCTTCTATCCCAGCGACATCGCCGTGGA GTGGGAGAGCAATGGGCAGCCGGAGAACAACT ACAAGACCACGCCTCCCGTGCTGGACTCCGACG GCTCCTTCTTCCTCTATAGCAAGCTCACCGTGGA CAAGAGCAGGTGGCAGCAGGGGAACGTCTTCTC ATGCTCCGTGATGCATGAGGCTCTGCACAACCA CTACACGCAGAAGAGCCTCTCCCTGTCTCCGGG TAAA SEQ ID NO: 2163 |
| | | AA | DIVMTQSPDSLAVSLGERATINCKSSQSVLSSSNNK NYLAWYQQKPGQPPKLLIYWTSTRDSGVPDRFSG SGSGTDFTLTINSLQAEDVAVYYCQQYYRTPWTF GQGTKVEIKRTVAAPSVFIFPPSDEQLKSGTASVVC LLNNFYPREAKVQWKVDNALQSGNSQESVTEQDS KDSTYSLSSTLTLSKADYEKHKVYACEVTHQGLSS PVTKSFNRGEC SEQ ID NO: 436 | QVQLVQSGAEVKKPGASVKVSCKASGYTFTGYYI HWVRQAPGQGLEWMGWISPNQGETNYAQKFQD RVTMTRDTSISTAYMELSSLRSDDTAVYYCAREA TIFGMLIVPFDYWGQGTLVTVSSASTKGPSVFPLA PSSKSTSGGTAALGCLVKDYFPEPVTVSWNSGALT SGVHTFPAVLQSSGLYSLSSVVTVPSSSLGTQTYIC NVNHKPSNTKVDKKVEPKSCDKTHTCPPCPAPEL LGGPSVFLFPPKPKDTLMISRTPEVTCVVVDVSHE DPEVKFNWYVDGVEVHNAKTKPCEEQYGSTYRC VSVLTVLHQDWLNGKEYKCKVSNKALPAPIEKTIS KAKGQPREPQVYTLPPSREEMTKNQVSLTCLVKG FYPSDIAVEWESNGQPENNYKTTPPVLDSDGSFFL YSKLTVDKSRWQQGNVFSCSVMHEALHNHYTQK SLSLSPGK SEQ ID NO: 593 |
| iPS:361402 | 12H11.014 | NA | GACATCGTGATGACCCAGTCTCCAGACTCCCTG GCTGTGTCTCTGGGCGAGAGGGCCACCATCAAC TGCAAGTCCAGCCAGAGTGTTTTATCCAGCTCC AACAATAAGAACTACTTAGCTTGGTACCAGCAG AAACCAGGACAGCCTCCTAAACTGCTCATTTAC TGGACTTCTACCCGAGAATCCGGGGTCCCTGAC ACGATTCAGTGGCAGCGGGTCTGGGACAGATTTC ACTCTCACCATCAACAGCCTGCAGGCTGAAGAT GTGGCTGTTTATTACTGTCAGCAATATTATCGTA CTCCGTGGACGTTCGGCCAAGGGACCAAGGTGG AAATCAAACGAACGGTGGCTGCACCATCTGTCT TCATCTTCCCGCCATCTGATGAGCAGTTGAAATC TGGAACTGCCTCTGTTGTGTGCCTGCTGAATAAC TTCTATCCCAGAGAGGCCAAAGTACAGTGGAAG GTGGATAACGCCCTCCAATCGGGTAACTCCCAG GAGAGTGTCACAGAGCAGGACAGCAAGGACAG CACCTACAGCCTCAGCAGCACCCTGACGCTGAG CAAAGCAGACTACGAGAAACACAAAGTCTACG CCTGCGAAGTCACCCATCAGGGCCTGAGCTCGC CCGTCACAAAGAGCTTCAACAGGGGAGAGTGT SEQ ID NO: 2007 | CAGGTGCAGCTGGTGCAGTCTGGGGCTGAGGTG AAGAAGCCTGGGGCCTCAGTGAAGGTCTCCTGC AAGGCTTCTGGATACACCTTCACCGGCTACTAT ATACACTGGGTGCGTCAGGCCCCTGGACAAGGG CTTGAGTGGATGGGGTGGATAAGCCCTAACCAA GGTGAAACAAACTATGCACAGAAGTTTCAGGAC AGGGTCACCATGACCAGGGACACGTCCATCAGC ACAGCCTATATGGAGCTGAGCAGCCTGAGATCT GACGACACGGCCGTGTATTACTGTGCGAGAGAG GCCACGATTTTTGGAATGCTTATTGTACCATTTG ACTACTGGGGCCAGGGAACCCTGGTCACCGTCT CCTCAGCCTCCACCAAGGGCCCATCGGTCTTCCC CCTGGCACCCTCCTCCAAGAGCACCTCTGGGGG CACAGCGGCCCTGGGCTGCCTGGTCAAGGACTA CTTCCCCGAACCGGTGACGGTGTCGTGGAACTC AGGCGCCCTGACCAGCGGCGTGCACACCTTCCC GGCTGTCCTACAGTCCTCAGGACTCTACTCCCTC AGCAGCGTGGTGACCGTGCCCTCCAGCAGCTTG GGCACCCAGACCTACATCTGCAACGTGAATCAC AAGCCCAGCAACACCAAGGTGGACAAGAAAGT TGAGCCCAAATCTTGTGACAAAACTCACACATG CCCACCGTGCCCAGCACCTGAACTCCTGGGGGG ACCGTCAGTCTTCCTCTTCCCCCCAAAACCCAAG GACACCCTCATGATCTCCCGGACCCCTGAGGTC ACATGCGTGGTGGTGGACGTGAGCCACGAAGAC CCTGAGGTCAAGTTCAACTGGTACGTGGACGGC |

TABLE 5-continued

Exemplary Light and Heavy Chain Nucleic Acid ("NA") and Amino Acid ("AA") Sequences

| iPS# | Ab | Type | LC | HC |
| --- | --- | --- | --- | --- |
| | | | | GTGGAGGTGCATAATGCCAAGACAAAGCCGTGT<br>GAGGAGCAGTACGGCAGCACGTACCGTTGTGTC<br>AGCGTCCTCACCGTCCTGCACCAGGACTGGCTG<br>AATGGCAAGGAGTACAAGTGCAAGGTCTCCAAC<br>AAAGCCCTCCCAGCCCCCATCGAGAAAACCATC<br>TCCAAAGCCAAAGGGCAGCCCCGAGAACCACA<br>GGTGTACACCCTGCCCCCATCCCGGGAGGAGAT<br>GACCAAGAACCAGGTCAGCCTGACCTGCCTGGT<br>CAAAGGCTTCTATCCCAGCGACATCGCCGTGGA<br>GTGGGAGAGCAATGGGCAGCCGGAGAACAACT<br>ACAAGACCACGCCTCCCGTGCTGGACTCCGACG<br>GCTCCTTCTTCCTCTATAGCAAGCTCACCGTGGA<br>CAAGAGCAGGTGGCAGCAGGGGAACGTCTTCTC<br>ATGCTCCGTGATGCATGAGGCTCTGCACAACCA<br>CTACACGCAGAAGAGCCTCTCCCTGTCTCCGGG<br>TAAA<br>SEQ ID NO: 2164 |
| | | AA | DIVMTQSPDSLAVSLGERATINCKSSQSVLSSSNNK<br>NYLAWYQQKPGQPPKLLIYWTSTRESGVPDRFSG<br>SGSGTDFTLTINSLQAEDVAVYYCQQYYRTPWTF<br>GQGTKVEIKRTVAAPSVFIFPPSDEQLKSGTASVVC<br>LLNNFYPREAKVQWKVDNALQSGNSQESVTEQDS<br>KDSTYSLSSTLTLSKADYEKHKVYACEVTHQGLSS<br>PVTKSFNRGEC<br>SEQ ID NO: 437 | QVQLVQSGAEVKKPGASVKVSCKASGYTFTGYYI<br>HWVRQAPGQGLEWMGWISPNQGETNYAQKFQD<br>RVTMTRDTSISTAYMELSSLRSDDTAVYYCAREA<br>TIFGMLIVPFDYWGQGTLVTVSSASTKGPSVFPLA<br>PSSKSTSGGTAALGCLVKDYFPEPVTVSWNSGALT<br>SGVHTFPAVLQSSGLYSLSSVVTVPSSSLGTQTYIC<br>NVNHKPSNTKVDKKVEPKSCDKTHTCPPCPAPEL<br>LGGPSVFLFPPKPKDTLMISRTPEVTCVVVDVSHE<br>DPEVKFNWYVDGVEVHNAKTKPCEEQYGSTYRC<br>VSVLTVLHQDWLNGKEYKCKVSNKALPAPIEKTIS<br>KAKGQPREPQVYTLPPSREEMTKNQVSLTCLVKG<br>FYPSDIAVEWESNGQPENNYKTTPPVLDSDGSFFL<br>YSKLTVDKSRWQQGNVFSCSVMHEALHNHYTQK<br>SLSLSPGK<br>SEQ ID NO: 594 |
| iPS:361406 | 2C2.005.001 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTCAAACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGAAAGCCTGAGTGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2008 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2165 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDESLSGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 438 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 595 |
| iPS:361412 | 2C2.005.002 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG ACAACATTCGATGAAAGCCTGCAAGGTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2009 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2166 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDESLQGPVFGGGTKG LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 439 | QMQVVQSGAEVKKPGASVKVSCKASGYTFTGYY MHWVRQAPGQGLEWMGWINPNSGGTNYAQKFQ RVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 596 |
| iPS:361418 | 2C2.005.003 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATTATG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGAAAGCCTGAGTGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2010 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2167 |
| | | AA | QSVLTQPPSASGTPGQRVTISCSGSSSNIGSNYVNW<br>YQHLPGTAPKLLIYTNNQRPSGVPDRFSGSKSGTS<br>ASLAISGLQSEDEADYFCATFDESLSGPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 440 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 597 |
| iPS:361424 | 2C2.005.004 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATTATG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGAAAGCCTGCAAGGTCCGGTAT<br>ATCGGCGGAGGGACCAAGCTGACCGTCCTAGGTC | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2011 | TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2168 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDESLQGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 441 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 598 |
| iPS:361430 | 2C2.005.005 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAATGGTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2012 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC |

TABLE 5-continued

| iPS# | Ab | Type | LC | HC |
|---|---|---|---|---|
| | | | | TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2169 |
| | | AA | QSVLTQPPSASGTPGQRVTISCSGSSSNIGSQTVNW YQHLPGTAPKLLIYTNNQRPSGVPDRFSGSKSGTS ASLAISGLQSEDEADYFCATFDDSLNGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 442 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 599 |
| iPS:361436 | 2C2.005.006 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAATGGTCCGGTAT TCGGCGGAGGGACCAAGCTGACCGTCCTAGGTC AGCCCAAGGCTGCCCCCTCGGTCACTCTGTTCCC AGCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2013 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2170 |
| | | AA | QSVLTQPPSASGTPGQRVTISCSGSSSNIGSNYVNW<br>YQHLPGTAPKLLIYTNNQRPSGVPDRFSGSKSGTS<br>ASLAISGLQSEDEADYFCATFDDSLNGPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 443 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 600 |
| iPS:361442 | 2C2.005.007 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGAAAGCCTGAATGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2014 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2171 |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDESLNGPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 444 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 601 |
| iPS:361448 | 2C2.005.008 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCACCTCCCAGGAACGGCCC ACCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGCAAGGTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2015 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2172 |
| | | AA | QSVLTQPPSASGTPGQRVTISCSGSSSNIGSNTVNW YQHLPGTAPKLLIYTNNQRPSGVPDRFSGSKSGTS ASLAISGLQSEDEADYFCATFDDSLQGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 445 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 602 |
| iPS:361454 | 2C2.005.009 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGACAGCCTGAGTGGTCCGGTAT TCGGCGGAGGGACCAAGCTGACCGTCCTAGGTC AGCCCAAGGCTGCCCCCTCGGTCACTCTGTTCCC | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2016 | ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2173 |
| iPS:361460 | 2C2.005.010 | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDDSLSGPVFGGGTKG<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 446 | QMQVVQSGAEVKKPGASVKVSCKASGYTFTGYY<br>MHWVRQAPGQGLEWMGWINPNSGGTNYAQKFQ<br>RVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 603 |
| iPS:361460 | 2C2.005.010 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATGACAGCCTGAATGCTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2017 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2174 |
| | | AA | QSVLTQPPSASGTPGQRVTISCSGSSSNIGSNTVNW<br>YQHLPGTAPKLLIYTNNQRPSGVPDRFSGSKSGTS<br>ASLAISGLQSEDEADYFCATFDDSLNAPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 447 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 604 |
| iPS:361466 | 2C2.005.011 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCACCTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATAGCAGCCTGAATGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2018 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>GCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>GAGGCTCTGCACAACCACTACACGCAGAAGAGC<br>CTCTCCCTGTCTCCGGGTAAA<br>SEQ ID NO: 2175 |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | AA | QSVLTQPPSASGTPGQRVTISCSGSSSNIGSNTVNW YQHLPGTAPKLLIYTNNQRPSGVPDRFSGSKSGTS ASLAISGLQSEDEADYFCATFDSSLNGPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 448 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 605 |
| iPS:361472 | 2C2.005.012 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG ACTCCAGTCTGAGGATGAGGCTGATTATTTCTGTG CAACATTCGATAGCAGCCTGAATGCTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2019 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTGGGGGACTTATCGGCCTCAC TACTACTACGGTATGGACGTCTGGGGCCAAGGG ACCACGGTCACCGTCTCCTCAGCCTCCACCAAG GGCCCATCGGTCTTCCCCCTGGCACCCTCCTCCA AGAGCACCTCTGGGGGCACAGCGGCCCTGGGCT GCCTGGTCAAGGACTACTTCCCCGAACCGGTGA CGGTGTCGTGGAACTCAGGCGCCCTGACCAGCG GCGTGCACACCTTCCCGGCTGTCCTACAGTCCTC AGGACTCTACTCCCTCAGCAGCGTGGTGACCGT GCCCTCCAGCAGCTTGGGCACCCAGACCTACAT CTGCAACGTGAATCACAAGCCCAGCAACACCAA GGTGGACAAGAAAGTTGAGCCCAAATCTTGTGA CAAAACTCACACATGCCCACCGTGCCCAGCACC TGAACTCCTGGGGGGACCGTCAGTCTTCCTCTTC CCCCCAAAACCCAAGGACACCCTCATGATCTCC CGGACCCCTGAGGTCACATGCGTGGTGGTGGAC GTGAGCCACGAAGACCCTGAGGTCAAGTTCAAC TGGTACGTGGACGGCGTGGAGGTGCATAATGCC AAGACAAAGCCGTGTGAGGAGCAGTACGGCAG CACGTACCGTTGTGTCAGCGTCCTCACCGTCCTG CACCAGGACTGGCTGAATGGCAAGGAGTACAA GTGCAAGGTCTCCAACAAAGCCCTCCCAGCCCC CATCGAGAAAACCATCTCCAAAGCCAAAGGGCA GCCCCGAGAACCACAGGTGTACACCCTGCCCCC ATCCCGGGAGGAGATGACCAAGAACCAGGTCA GCCTGACCTGCCTGGTCAAAGGCTTCTATCCCA GCGACATCGCCGTGGAGTGGGAGAGCAATGGG CAGCCGGAGAACAACTACAAGACCACGCCTCCC GTGCTGGACTCCGACGGCTCCTTCTTCCTCTATA GCAAGCTCACCGTGGACAAGAGCAGGTGGCAG CAGGGGAACGTCTTCTCATGCTCCGTGATGCAT GAGGCTCTGCACAACCACTACACGCAGAAGAGC CTCTCCCTGTCTCCGGGTAAA SEQ ID NO: 2176 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDSSLNAPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 449 | QMQVVQSGAEVKKPGASVKVSCKASGYTFTGYY MHWVRQAPGQGLEWMGWINPNSGGTNYAQKFQ GRVTMTRDTSISTAYMELSRLRSDDTAVYYCARG GDYVWGTYRPHYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 606 |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| iPS:361478 | 2C2.005.013 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTAATTATG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATAGCAGCCTGAATGCTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC ACCCTCCAAACAAAGCAACAACAAGTACGCGGC CAGCAGCTATCTGAGCCTGACGCCTGAGCAGTG GAAGTCCCACAGAAGCTACAGCTGCCAGGTCAC GCATGAAGGGAGCACCGTGGAGAAGACAGTGG CCCCTACAGAATGTTCA SEQ ID NO: 2020 | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGCCTGAGGTCT GACGACACGGCCGTGTATTACTGTGCGAGAGGG GGGGATTACGTTTTCGGGACTTATCGGCCTCACT ACTACTACGGTATGGACGTCTGGGGCCAAGGGA CCACGGTCACCGTCTCCTCAGCCTCCACCAAGG GCCCATCGGTCTTCCCCCTGGCACCCTCCTCCAA GAGCACCTCTGGGGGCACAGCGGCCCTGGGCTG CCTGGTCAAGGACTACTTCCCCGAACCGGTGAC GGTGTCGTGGAACTCAGGCGCCCTGACCAGCGG CGTGCACACCTTCCCGGCTGTCCTACAGTCCTCA GGACTCTACTCCCTCAGCAGCGTGGTGACCGTG CCCTCCAGCAGCTTGGGCACCCAGACCTACATC TGCAACGTGAATCACAAGCCCAGCAACACCAAG GTGGACAAGAAAGTTGAGCCCAAATCTTGTGAC AAAACTCACACATGCCCACCGTGCCCAGCACCT GAACTCCTGGGGGGACCGTCAGTCTTCCTCTTCC CCCCAAAACCCAAGGACACCCTCATGATCTCCC GGACCCCTGAGGTCACATGCGTGGTGGTGGACG TGAGCCACGAAGACCCTGAGGTCAAGTTCAACT GGTACGTGGACGGCGTGGAGGTGCATAATGCCA AGACAAAGCCGTGTGAGGAGCAGTACGGCAGC ACGTACCGTTGTGTCAGCGTCCTCACCGTCCTGC ACCAGGACTGGCTGAATGGCAAGGAGTACAAGT GCAAGGTCTCCAACAAAGCCCTCCCAGCCCCCA TCGAGAAAACCATCTCCAAAGCCAAAGGGCAGC CCCGAGAACCACAGGTGTACACCCTGCCCCCAT CCCGGGAGGAGATGACCAAGAACCAGGTCAGC CTGACCTGCCTGGTCAAAGGCTTCTATCCCAGC GACATCGCCGTGGAGTGGGAGAGCAATGGGCA GCCGGAGAACAACTACAAGACCACGCCTCCCGT GCTGGACTCCGACGGCTCCTTCTTCCTCTATAGC AAGCTCACCGTGGACAAGAGCAGGTGGCAGCA GGGGAACGTCTTCTCATGCTCCGTGATGCATGA GGCTCTGCACAACCACTACACGCAGAAGAGCCT CTCCCTGTCTCCGGGTAAA SEQ ID NO: 2177 |
| | | AA | QSVLTQPPSASGTPGQRVTISCSGSSSNIGSNYVNW YQHLPGTAPKLLIYTNNQRPSGVPDRFSGSKSGTS ASLAISGLQSEDEADYFCATFDSSLNAPVFGGGTK LTVLGQPKAAPSVTLFPPSSEELQANKATLVCLISD FYPGAVTVAWKADSSPVKAGVETTTPSKQSNNKY AASSYLSLTPEQWKSHRSYSCQVTHEGSTVEKTV APTECS SEQ ID NO: 450 | QMQVVQSGAEVKKPGASVKVSCKASGYTFTGYY MHWVRQAPGQGLEWMGWINPNSGGTNYAQKFQ GRVTMTRDTSISTAYMELSSLRSDDTAVYYCARG GDYVFGTYRPHYYYGMDVWGQGTTVTVSSASTK GPSVFPLAPSSKSTSGGTAALGCLVKDYFPEPVTV SWNSGALTSGVHTFPAVLQSSGLYSLSSVVTVPSS SLGTQTYICNVNHKPSNTKVDKKVEPKSCDKTHT CPPCPAPELLGGPSVFLFPPKPKDTLMISRTPEVTC VVVDVSHEDPEVKFNWYVDGVEVHNAKTKPCEE QYGSTYRCVSVLTVLHQDWLNGKEYKCKVSNKA LPAPIEKTISKAKGQPREPQVYTLPPSREEMTKNQV SLTCLVKGFYPSDIAVEWESNGQPENNYKTTPPVL DSDGSFFLYSKLTVDKSRWQQGNVFSCSVMHEAL HNHYTQKSLSLSPGK SEQ ID NO: 607 |
| iPS:361485 | 2C2.005.014 | NA | CAGTCTGTGCTGACTCAGCCACCCTCAGCGTCTG GGACCCCCGGGCAGAGGGTCACCATCTCTTGTT CTGGAAGTAGCTCCAACATCGGAAGTCAAACTG TAAACTGGTACCAGCACCTCCCAGGAACGGCCC CCAAACTCCTCATCTATACTAATAATCAGCGGC CCTCAGGGGTCCCTGACCGATTCTCTGGCTCCAA GTCTGGCACCTCAGCCTCCCTTGCCATCAGTGGG CTCCAGTCTGAGGATGAGGCTGATTATTTCTGTG CAACATTCGATGAAAGCCTGAGTGGTCCGGTAT TCGGCGGAGGGACCAAGCTGACCGTCCTAGGTC AGCCCAAGGCTGCCCCCTCGGTCACTCTGTTCCC GCCCTCCTCTGAGGAGCTTCAAGCCAACAAGGC CACACTGGTGTGTCTCATAAGTGACTTCTACCCG GGAGCCGTGACAGTGGCCTGGAAGGCAGATAG CAGCCCCGTCAAGGCGGGAGTGGAGACCACCAC | CAGATGCAGGTGGTGCAGTCTGGGGCTGAGGTG AAGAAGCCTGGGGCCTCAGTGAAGGTCTCCTGC AAGGCTTCCGGATACACCTTCACCGGCTACTAT ATGCATTGGGTGCGACAGGCCCCTGGACAAGGG CTTGAGTGGATGGGATGGATCAACCCTAACAGT GGTGGCACAAACTATGCACAGAAGTTTCAGGGC AGGGTCACCATGACCAGGGACACGTCCATCAGT ACAGCCTACATGGAGCTGAGCAGGCTGAGGTCT GACGACACGGCCGTGTATTACTGTGCGAGAGGG GGGGATTACGTTTTCGGGACTTATCGGCCTCACT ACTACTACGGTATGGACGTCTGGGGCCAAGGGA CCACGGTCACCGTCTCCTCAGCCTCCACCAAGG GCCCATCGGTCTTCCCCCTGGCACCCTCCTCCAA GAGCACCTCTGGGGGCACAGCGGCCCTGGGCTG CCTGGTCAAGGACTACTTCCCCGAACCGGTGAC |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2021 | GGTGTCGTGGAACTCAGGCGCCCTGACCAGCGG<br>CGTGCACACCTTCCCGGCTGTCCTACAGTCCTCA<br>GGACTCTACTCCCTCAGCAGCGTGGTGACCGTG<br>CCCTCCAGCAGCTTGGGCACCCAGACCTACATC<br>TGCAACGTGAATCACAAGCCCAGCAACACCAAG<br>GTGGACAAGAAAGTTGAGCCCAAATCTTGTGAC<br>AAAACTCACACATGCCCACCGTGCCCAGCACCT<br>GAACTCCTGGGGGGACCGTCAGTCTTCCTCTTCC<br>CCCCAAAACCCAAGGACACCCTCATGATCTCCC<br>GGACCCCTGAGGTCACATGCGTGGTGGTGGACG<br>TGAGCCACGAAGACCCTGAGGTCAAGTTCAACT<br>GGTACGTGGACGGCGTGGAGGTGCATAATGCCA<br>AGACAAAGCCGTGTGAGGAGCAGTACGGCAGC<br>ACGTACCGTTGTGTCAGCGTCCTCACCGTCCTGC<br>ACCAGGACTGGCTGAATGGCAAGGAGTACAAGT<br>GCAAGGTCTCCAACAAAGCCCTCCCAGCCCCCA<br>TCGAGAAAACCATCTCCAAAGCCAAAGGGCAGC<br>CCCGAGAACCACAGGTGTACACCCTGCCCCCAT<br>CCCGGGAGGAGATGACCAAGAACCAGGTCAGC<br>CTGACCTGCCTGGTCAAAGGCTTCTATCCCAGC<br>GACATCGCCGTGGAGTGGGAGAGCAATGGGCA<br>GCCGGAGAACAACTACAAGACCACGCCTCCCGT<br>GCTGGACTCCGACGGCTCCTTCTTCCTCTATAGC<br>AAGCTCACCGTGGACAAGAGCAGGTGGCAGCA<br>GGGGAACGTCTTCTCATGCTCCGTGATGCATGA<br>GGCTCTGCACAACCACTACACGCAGAAGAGCCT<br>CTCCCTGTCTCCGGGTAAA<br>SEQ ID NO: 2178 |
| | | AA | QSVLTQPPSASGTPGQRVTISCSGSSSNIGSQTVNW<br>YQHLPGTAPKLLIYTNNQRPSGVPDRFSGSKSGTS<br>ASLAISGLQSEDEADYFCATFDESLSGPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 451 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVFGTYRPHYYYGMDVWGQGTTVTVSSASTK<br>GPSVFPLAPSSKSTSGGTAALGCLVKDYFPEPVTV<br>SWNSGALTSGVHTFPAVLQSSGLYSLSSVVTVPSS<br>SLGTQTYICNVNHKPSNTKVDKKVEPKSCDKTHT<br>CPPCPAPELLGGPSVFLFPPKPKDTLMISRTPEVTC<br>VVVDVSHEDPEVKFNWYVDGVEVHNAKTKPCEE<br>QYGSTYRCVSVLTVLHQDWLNGKEYKCKVSNKA<br>LPAPIEKTISKAKGQPREPQVYTLPPSREEMTKNQV<br>SLTCLVKGFYPSDIAVEWESNGQPENNYKTTPPVL<br>DSDGSFFLYSKLTVDKSRWQQGNVFSCSVMHEAL<br>HNHYTQKSLSLSPGK<br>SEQ ID NO: 608 |
| iPS:361845 | 18F2.013 | NA | GACATCCAGATGACCCAGTCTCCATCCTCCCTGT<br>CTGCATCTATAGGAGACAGAGTCACCATCACTT<br>GCCGGGCAAGTCAGGACCTTAGAAATTATTTAG<br>GCTGGTATCAACAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 2022 | CAGGTGCAGCTGGTGGAGTCTGGGGGAGGCGTG<br>GTCCAGCCTGGGAGGTCCCTGAGACTCTCCTGT<br>GCAGCGTCTGGATTCACTTTCAGTAACTTTGGCA<br>TGCACTGGGTCCGCCAGGCCCCAGGCAAGGGGC<br>TGGAGTGGGTGGCAGTTATATGGTATGATGCAA<br>GTAATGAAAACTATGCAGACGCCGTGAAGGGCC<br>GATTCACCATCTCCAGAGACAATTCCAAGAACA<br>CGCTGTATCTGCAAATGAACAGCCTGAGAGCCG<br>AGGACACGGCTGTGTATTACTGTGCGAGAGATA<br>GGACGATCTTTGGAGTGGTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2179 |
| | | AA | DIQMTQSPSSLSASIGDRVTITCRASQDLRNYLGW<br>YQQKPGKAPKRLIYGASSLQSGVPSRFSGSGSGTE<br>FTLTISSLQPEDFATYYCLQHNNYPFTFGQGTKVDI<br>KRTVAAPSVFIFPPSDEQLKSGTASVVCLLNNFYPR<br>EAKVQWKVDNALQSGNSQESVTEQDSKDSTYSLS<br>STLTLSKADYEKHKVYACEVTHQGLSSPVTKSFN<br>RGEC<br>SEQ ID NO: 452 | QVQLVESGGGVVQPGRSLRLSCAASGFTFSNFGM<br>HWVRQAPGKGLEWVAVIWYDASNENYADAVKG<br>RFTISRDNSKNTLYLQMNSLRAEDTAVYYCARDR<br>TIFGVVLGDYWGQGTLVTVSSASTKGPSVFPLAPS<br>SKSTSGGTAALGCLVKDYFPEPVTVSWNSGALTS<br>GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>ASVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 609 |
| iPS:361851 | 6H1.009 | NA | GACATCCAGATGACCCAGTCTCCATCCTCCCTGT<br>CTGCATCTATAGGAGACAGAGTCACCATCACTT<br>GCCGGGCAAGTCAGGACATTAGAGATTATTTAG<br>GCTGGTATCAGCAGAAACCAGGGAAAGCCCCTA<br>AGCGCCTGATCTATGGTGCATCCAGTTTGCAAA<br>GTGGGGTCCCTTCAAGGTTCAGCGGCAGTGGAT<br>CTGGGACAGAATTCACTCTCACAATCAGCAGCC<br>TGCAGCCTGAAGATTTCGCAACTTATTACTGTCT<br>ACAGCATAATAATTACCCCTTCACTTTCGGCCAA<br>GGGACCAAAGTGGATATCAAACGAACGGTGGCT<br>GCACCATCTGTCTTCATCTTCCCGCCATCTGATG<br>AGCAGTTGAAATCTGGAACTGCCTCTGTTGTGT<br>GCCTGCTGAATAACTTCTATCCCAGAGAGGCCA<br>AAGTACAGTGGAAGGTGGATAACGCCCTCCAAT<br>CGGGTAACTCCCAGGAGAGTGTCACAGAGCAGG<br>ACAGCAAGGACAGCACCTACAGCCTCAGCAGCA<br>CCCTGACGCTGAGCAAAGCAGACTACGAGAAAC<br>ACAAAGTCTACGCCTGCGAAGTCACCCATCAGG<br>GCCTGAGCTCGCCCGTCACAAAGAGCTTCAACA<br>GGGGAGAGTGT<br>SEQ ID NO: 2023 | CAGGTGCAGCTGGTGGAGTCTGGGGGAGGCGTG<br>GTCCAGCCTGGGAGGTCCCTGAGACTCTCCTGT<br>GCAGCGTCTGGATTCACCTTCAGTTACTTTGGCA<br>TGCACTGGGTCCGCCAGGCTCCAGGCAAGGGGC<br>TGGAGTGGGTGGCAGTTATATGGTATGATGCAA<br>GTAATAAATACTATGCAGACGCCGTGAAGGGCC<br>GCTTCACCATCTCCAGAGACAATTCCAAGAACA<br>CGCTGTATCTGCAAATGAACAGCCTGAGAGCCG<br>AGGACACGGCTGTGTATTACTGTGCGCGAGATA<br>GGACGATTTTTGGAGTGCTCTTGGGGGACTACT<br>GGGGCCAGGGAACCCTGGTCACCGTCTCCTCAG<br>CCTCCACCAAGGGCCCATCGGTCTTCCCCCTGGC<br>ACCCTCCTCCAAGAGCACCTCTGGGGGCACAGC<br>GGCCCTGGGCTGCCTGGTCAAGGACTACTTCCC<br>CGAACCGGTGACGGTGTCGTGGAACTCAGGCGC<br>CCTGACCAGCGGCGTGCACACCTTCCCGGCTGT<br>CCTACAGTCCTCAGGACTCTACTCCCTCAGCAGC<br>GTGGTGACCGTGCCCTCCAGCAGCTTGGGCACC<br>CAGACCTACATCTGCAACGTGAATCACAAGCCC<br>AGCAACACCAAGGTGGACAAGAAAGTTGAGCC<br>CAAATCTTGTGACAAAACTCACACATGCCCACC<br>GTGCCCAGCACCTGAACTCCTGGGGGGACCGTC<br>AGTCTTCCTCTTCCCCCCAAAACCCAAGGACAC<br>CCTCATGATCTCCCGGACCCCTGAGGTCACATG<br>CGTGGTGGTGGACGTGAGCCACGAAGACCCTGA<br>GGTCAAGTTCAACTGGTACGTGGACGGCGTGGA<br>GGTGCATAATGCCAAGACAAAGCCGTGTGAGGA<br>GCAGTACGGCAGCACGTACCGTTGTGTCAGCGT<br>CCTCACCGTCCTGCACCAGGACTGGCTGAATGG<br>CAAGGAGTACAAGTGCAAGGTCTCCAACAAAGC<br>CCTCCCAGCCCCCATCGAGAAAACCATCTCCAA<br>AGCCAAAGGGCAGCCCCGAGAACCACAGGTGT<br>ACACCCTGCCCCCATCCCGGGAGGAGATGACCA<br>AGAACCAGGTCAGCCTGACCTGCCTGGTCAAAG<br>GCTTCTATCCCAGCGACATCGCCGTGGAGTGGG<br>AGAGCAATGGGCAGCCGGAGAACAACTACAAG<br>ACCACGCCTCCCGTGCTGGACTCCGACGGCTCC<br>TTCTTCCTCTATAGCAAGCTCACCGTGGACAAG<br>AGCAGGTGGCAGCAGGGGAACGTCTTCTCATGC<br>TCCGTGATGCATGAGGCTCTGCACAACCACTAC<br>ACGCAGAAGAGCCTCTCCCTGTCTCCGGGTAAA<br>SEQ ID NO: 2180 |
| | | AA | DIQMTQSPSSLSASIGDRVTITCRASQDIRDYLGWY<br>QQKPGKAPKRLIYGASSLQSGVPSRFSGSGSGTEFT<br>LTISSLQPEDFATYYCLQHNNYPFTFGQGTKVDIK<br>RTVAAPSVFIFPPSDEQLKSGTASVVCLLNNFYPRE<br>AKVQWKVDNALQSGNSQESVTEQDSKDSTYSLSS | QVQLVESGGGVVQPGRSLRLSCAASGFTFSYFGM<br>HWVRQAPGKGLEWVAVIWYDASNKYYADAVKG<br>RFTISRDNSKNTLYLQMNSLRAEDTAVYYCARDR<br>TIFGVLLGDYWGQGTLVTVSSASTKGPSVFPLAPS<br>SKSTSGGTAALGCLVKDYFPEPVTVSWNSGALTS |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TLTLSKADYEKHKVYACEVTHQGLSSPVTKSFNR<br>GEC<br>SEQ ID NO: 453 | GVHTFPAVLQSSGLYSLSSVVTVPSSSLGTQTYICN<br>VNHKPSNTKVDKKVEPKSCDKTHTCPPCPAPELL<br>GGPSVFLFPPKPKDTLMISRTPEVTCVVVDVSHED<br>PEVKFNWYVDGVEVHNAKTKPCEEQYGSTYRCV<br>SVLTVLHQDWLNGKEYKCKVSNKALPAPIEKTISK<br>AKGQPREPQVYTLPPSREEMTKNQVSLTCLVKGF<br>YPSDIAVEWESNGQPENNYKTTPPVLDSDGSFFLY<br>SKLTVDKSRWQQGNVFSCSVMHEALHNHYTQKS<br>LSLSPGK<br>SEQ ID NO: 610 |
| iPS:361855 | 2C2.005.015 | NA | CAGTCTGTGCTGACTCAGCCACCCTCAGCGTCTG<br>GGACCCCCGGGCAGAGGGTCACCATCTCTTGTT<br>CTGGAAGTAGCTCCAACATCGGAAGTAATACTG<br>TAAACTGGTACCAGCAACTCCCAGGAACGGCCC<br>CCAAACTCCTCATCTATACTAATAATCAGCGGC<br>CCTCAGGGGTCCCTGACCGATTCTCTGGCTCCAA<br>GTCTGGCACCTCAGCCTCCCTTGCCATCAGTGGG<br>CTCCAGTCTGAGGATGAGGCTGATTATTTCTGTG<br>CAACATTCGATAGCAGCCTGAGTGGTCCGGTAT<br>TCGGCGGAGGGACCAAGCTGACCGTCCTAGGTC<br>AGCCCAAGGCTGCCCCCTCGGTCACTCTGTTCCC<br>GCCCTCCTCTGAGGAGCTTCAAGCCAACAAGGC<br>CACACTGGTGTGTCTCATAAGTGACTTCTACCCG<br>GGAGCCGTGACAGTGGCCTGGAAGGCAGATAG<br>CAGCCCCGTCAAGGCGGGAGTGGAGACCACCAC<br>ACCCTCCAAACAAAGCAACAACAAGTACGCGGC<br>CAGCAGCTATCTGAGCCTGACGCCTGAGCAGTG<br>GAAGTCCCACAGAAGCTACAGCTGCCAGGTCAC<br>GCATGAAGGGAGCACCGTGGAGAAGACAGTGG<br>CCCCTACAGAATGTTCA<br>SEQ ID NO: 2024 | CAGATGCAGGTGGTGCAGTCTGGGGCTGAGGTG<br>AAGAAGCCTGGGGCCTCAGTGAAGGTCTCCTGC<br>AAGGCTTCCGGATACACCTTCACCGGCTACTAT<br>ATGCATTGGGTGCGACAGGCCCCTGGACAAGGG<br>CTTGAGTGGATGGGATGGATCAACCCTAACAGT<br>GGTGGCACAAACTATGCACAGAAGTTTCAGGGC<br>AGGGTCACCATGACCAGGGACACGTCCATCAGT<br>ACAGCCTACATGGAGCTGAGCAGGCTGAGGTCT<br>GACGACACGGCCGTGTATTACTGTGCGAGAGGG<br>GGGGATTACGTTTGGGGGACTTATCGGCCTCAC<br>TACTACTACGGTATGGACGTCTGGGGCCAAGGG<br>ACCACGGTCACCGTCTCCTCAGCCTCCACCAAG<br>GGCCCATCGGTCTTCCCCCTGGCACCCTCCTCCA<br>AGAGCACCTCTGGGGGCACAGCGGCCCTGGGCT<br>GCCTGGTCAAGGACTACTTCCCCGAACCGGTGA<br>CGGTGTCGTGGAACTCAGGCGCCCTGACCAGCG<br>GCGTGCACACCTTCCCGGCTGTCCTACAGTCCTC<br>AGGACTCTACTCCCTCAGCAGCGTGGTGACCGT<br>GCCCTCCAGCAGCTTGGGCACCCAGACCTACAT<br>CTGCAACGTGAATCACAAGCCCAGCAACACCAA<br>GGTGGACAAGAAAGTTGAGCCCAAATCTTGTGA<br>CAAAACTCACACATGCCCACCGTGCCCAGCACC<br>TGAACTCCTGGGGGGACCGTCAGTCTTCCTCTTC<br>CCCCCAAAACCCAAGGACACCCTCATGATCTCC<br>CGGACCCCTGAGGTCACATGCGTGGTGGTGGAC<br>GTGAGCCACGAAGACCCTGAGGTCAAGTTCAAC<br>TGGTACGTGGACGGCGTGGAGGTGCATAATGCC<br>AAGACAAAGCCGTGTGAGGAGCAGTACGGCAG<br>CACGTACCGTTGTGTCAGCGTCCTCACCGTCCTG<br>CACCAGGACTGGCTGAATGGCAAGGAGTACAA<br>GTGCAAGGTCTCCAACAAAGCCCTCCCAGCCCC<br>CATCGAGAAAACCATCTCCAAAGCCAAAGGGCA<br>GCCCCGAGAACCACAGGTGTACACCCTGCCCCC<br>ATCCCGGGAGGAGATGACCAAGAACCAGGTCA<br>AGCCTGACCTGCCTGGTCAAAGGCTTCTATCCCA<br>GCGACATCGCCGTGGAGTGGGAGAGCAATGGG<br>CAGCCGGAGAACAACTACAAGACCACGCCTCCC<br>GTGCTGGACTCCGACGGCTCCTTCTTCCTCTATA<br>GCAAGCTCACCGTGGACAAGAGCAGGTGGCAG<br>CAGGGGAACGTCTTCTCATGCTCCGTGATGCAT<br>NGAGGCTCTGCACAACCACTACACGCAGAAGAGC<br>CTCTCCCTGTCTCCGGGTAAA<br>SEQ ID NO: 2181 |
| | | AA | QSVLTQPPSASGTPGQRVTISCSGSSSNIGSNTVNW<br>YQQLPGTAPKLLIYTNNQRPSGVPDRFSGSKSGTS<br>ASLAISGLQSEDEADYFCATFDSSLSGPVFGGGTK<br>LTVLGQPKAAPSVTLFPPSSEELQANKATLVCLISD<br>FYPGAVTVAWKADSSPVKAGVETTTPSKQSNNKY<br>AASSYLSLTPEQWKSHRSYSCQVTHEGSTVEKTV<br>APTECS<br>SEQ ID NO: 454 | QMQVVQSGAEVKKPGASVKVSCKASGYTFTGYY<br>MHWVRQAPGQGLEWMGWINPNSGGTNYAQKFQ<br>GRVTMTRDTSISTAYMELSRLRSDDTAVYYCARG<br>GDYVWGTYRPHYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 611 |
| iPS:336067 | 5G12.006 | NA | GACATCCAGCTGACCCAGTCTCCATCCTCCCTGT<br>CTGCATCTGTAGGAGACAGAGTCACTATCACTT<br>GCCGGGCAAGTCAGACCATTAGCAGGTTTTTAA<br>ATTGGTATCAGCAGAAACCTGGGAAAGCCCCTG<br>AGCTCCTGATCTATGTTGCATCCAGTTTGCAAAG | CAGGTGCAGTTGGTGGAGTCTGGGGGAGGCGTG<br>GTCCAGCCTGGGAGGTCCCTGAGACTCTCCTGT<br>ACAGCGTCTGGATTCACCTTCAGTAGCTATGGC<br>ATACACTGGGTCCGCCAGGCTCCAGGCAAGGGG<br>CTGGAGTGGGTGGCAGTTATATGGTATGATGGA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TGGGGTCCCATCAAGATTCAGTGGCAGTGGTTC<br>TGGGACAGATTTCACTCTCACCATCAGCAGTCT<br>GCAACCTGAAGATTTTGCAACTTACTACTGTCA<br>ACAGAGTTACAGTACCCTGATCAGTTTTGGCCA<br>GGGGACCAAGCTGGAGATCACACGAACGGTGG<br>CTGCACCATCTGTCTTCATCTTCCCGCCATCTGA<br>TGAGCAGTTGAAATCTGGAACTGCCTCTGTTGT<br>GTGCCTGCTGAATAACTTCTATCCCAGAGAGGC<br>CAAAGTACAGTGGAAGGTGGATAACGCCCTCCA<br>ATCGGGTAACTCCCAGGAGAGTGTCACAGAGCA<br>GGACAGCAAGGACAGCACCTACAGCCTCAGCA<br>GCACCCTGACGCTGAGCAAAGCAGACTACGAGA<br>AACACAAAGTCTACGCCTGCGAAGTCACCCATC<br>AGGGCCTGAGCTCGCCCGTCACAAAGAGCTTCA<br>ACAGGGGAGAGTGT<br>SEQ ID NO: 2025 | AGTAATAAGTTCCATGCAGACTCCGTGAAGGGC<br>CGATTCACCATCTCCAGAGACAATTCCAAGAAC<br>ACGCTGTATCTGCAAATGAACAGCCTGAGAGCC<br>GAGGACTCGGCTATGTACTTCTGTGCGAGAGGA<br>AAAGTGGCTGGTATGCCTGAAGCTTTTGAAATC<br>TGGGGCCAAGGGACAAAGGTCACCGTCTCTTCA<br>GCCTCCACCAAGGGCCCATCGGTCTTCCCCCTG<br>GCACCCTCCTCCAAGAGCACCTCTGGGGGCACA<br>GCGGCCCTGGGCTGCCTGGTCAAGGACTACTTC<br>CCCGAACCGGTGACGGTGTCGTGGAACTCAGGC<br>GCCCTGACCAGCGGCGTGCACACCTTCCCGGCT<br>GTCCTACAGTCCTCAGGACTCTACTCCCTCAGCA<br>GCGTGGTGACCGTGCCCTCCAGCAGCTTGGGCA<br>CCCAGACCTACATCTGCAACGTGAATCACAAGC<br>CCAGCAACACCAAGGTGGACAAGAAAGTTGAG<br>CCCAAATCTTGTGACAAAACTCACACATGCCCA<br>CCGTGCCCAGCACCTGAACTCCTGGGGGGACCG<br>TCAGTCTTCCTCTTCCCCCCAAAACCCAAGGACA<br>CCCTCATGATCTCCCGGACCCCTGAGGTCACAT<br>GCGTGGTGGTGGACGTGAGCCACGAAGACCCTG<br>AGGTCAAGTTCAACTGGTACGTGGACGGCGTGG<br>AGGTGCATAATGCCAAGACAAAGCCGTGTGAGG<br>AGCAGTACGGCAGCACGTACCGTTGTGTCAGCG<br>TCCTCACCGTCCTGCACCAGGACTGGCTGAATG<br>GCAAGGAGTACAAGTGCAAGGTCTCCAACAAA<br>GCCCTCCCAGCCCCCATCGAGAAAACCATCTCC<br>AAAGCCAAAGGGCAGCCCCGAGAACCACAGGT<br>GTACACCCTGCCCCCATCCCGGGAGGAGATGAC<br>CAAGAACCAGGTCAGCCTGACCTGCCTGGTCAA<br>AGGCTTCTATCCCAGCGACATCGCCGTGGAGTG<br>GGAGAGCAATGGGCAGCCGGAGAACAACTACA<br>AGACCACGCCTCCCGTGCTGGACTCCGACGGCT<br>CCTTCTTCCTCTATAGCAAGCTCACCGTGGACAA<br>GAGCAGGTGGCAGCAGGGGAACGTCTTCTCATG<br>CTCCGTGATGCATGAGGCTCTGCACAACCACTA<br>CACGCAGAAGAGCCTCTCCCTGTCTCCGGGTAA<br>A<br>SEQ ID NO: 2182 |
| | | AA | DIQLTQSPSSLSASVGDRVTITCRASQTISRFLNWY<br>QQKPGKAPELLIYVASSLQSGVPSRFSGSGSGTDFT<br>LTISSLQPEDFATYYCQQSYSTLISFGQGTKLEITR<br>TVAAPSVFIFPPSDEQLKSGTASVVCLLNNFYPREA<br>PKVQWKVDNALQSGNSQESVTEQDSKDSTYSLSST<br>LTLSKADYEKHKVYACEVTHQGLSSPVTKSFNRG<br>EC<br>SEQ ID NO: 455 | QVQLVESGGGVVQPGRSLRLSCTASGFTFSSYGIH<br>WVRQAPGKGLEWVAVIWYDGSNKFHADSVKGRF<br>TISRDNSKNTLYLQMNSLRAEDSAMYFCARGKVA<br>GMPEAFEIWGQGTKVTVSSASTKGSVFPLAPSSK<br>STSGGTAALGCLVKDYFPEPVTVSWNSGALTSGV<br>HTFPAVLQSSGLYSLSSVVTVPSSSLGTQTYICNVN<br>HKPSNTKVDKKVEPKSCDKTHTCPPCPAPELLGGP<br>SVFLFPPKPKDTLMISRTPEVTCVVVDVSHEDPEV<br>KFNWYVDGVEVHNAKTKPCEEQYGSTYRCVSVL<br>TVLHQDWLNGKEYKCKVSNKALPAPIEKTISKAK<br>GQPREPQVYTLPPSREEMTKNQVSLTCLVKGFYPS<br>DIAVEWESNGQPENNYKTTPPVLDSDGSFFLYSKL<br>TVDKSRWQQGNVFSCSVMHEALHNHYTQKSLSL<br>SPGK<br>SEQ ID NO: 612 |
| iPS:336169 | 17B11.002 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATGAGCAGTTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGGCATCACCGG<br>ACTCCAGACTGGGGACGAGGCCGATTATTACTG<br>CGGAACATGGGATAGCAGCCTGAGTGCTGTGGT<br>ATTCGGCGGAGGGACCAAACTGACCGTCCTAGG<br>TCAGCCCAAGGCTGCCCCCTCGGTCACTCTGTTC<br>CCGCCCTCCTCTGAGGAGCTTCAAGCCAACAAG<br>GCCACACTGGTGTGTCTCATAAGTGACTTCTACC<br>CGGGAGCCGTGACAGTGGCCTGGAAGGCAGAT<br>AGCAGCCCCGTCAAGGCGGGAGTGGAGACCAC<br>CACACCCTCCAAACAAAGCAACAACAAGTACGC<br>GGCCAGCAGCTATCTGAGCCTGACGCCTGAGCA<br>GTGGAAGTCCCACAGAAGCTACAGCTGCCAGGT<br>CACGCATGAAGGGAGCACCGTGGAGAAGACAG<br>TGGCCCCTACAGAATGTTCA<br>SEQ ID NO: 2026 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCACTGGACAAGGG<br>CTTGAGTGGATGGGATGGATGAACCCTAACAGT<br>GGTAACACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>CAGGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCAGCCTCCACCA<br>AGGGCCCATCGGTCTTCCCCCTGGCACCCTCCTC<br>CAAGAGCACCTCTGGGGGCACAGCGGCCCTGGG<br>CTGCCTGGTCAAGGACTACTTCCCCGAACCGGT<br>GACGGTGTCGTGGAACTCAGGCGCCCTGACCAG<br>CGGCGTGCACACCTTCCCGGCTGTCCTACAGTCC<br>TCAGGACTCTACTCCCTCAGCAGCGTGGTGACC<br>GTGCCCTCCAGCAGCTTGGGCACCCAGACCTAC<br>ATCTGCAACGTGAATCACAAGCCCAGCAACACC<br>AAGGTGGACAAGAAAGTTGAGCCCAAATCTTGT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GACAAAACTCACACATGCCCACCGTGCCCAGCA CCTGAACTCCTGGGGGGACCGTCAGTCTTCCTCT TCCCCCCAAAACCCAAGGACACCCTCATGATCT CCCGGACCCCTGAGGTCACATGCGTGGTGGTGG ACGTGAGCCACGAAGACCCTGAGGTCAAGTTCA ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA GCAGGGGAACGTCTTCTCATGCTCCGTGATGCA TGAGGCTCTGCACAACCACTACACGCAGAAGAG CCTCTCCCTGTCTCCGGGTAAA SEQ ID NO: 2183 |
| | | AA | QSVLTQPPSVSAAPGQKVTISCSGSSSNIGNNYVS WYEQFPGTAPKLLIYDNNKRPSGIPDRFSGSKSGTS ATLGITGLQTGDEADYYCGTWDSSLSAVVFGGGT KLTVLGQPKAAPSVTLFPPSSEELQANKATLVCLIS DFYPGAVTVAWKADSSPVKAGVETTTPSKQSNNK YAASSYLSLTPEQWKSHRSYSCQVTHEGSTVEKT VAPTECS SEQ ID NO: 456 | QMQLVQSGAEVKKPGASVKVSCKASGYTFTSYDI NWVRQATGQGLEWMGWMNPNSGNTGYAQKFQ GRVTMTRDTSISTAYMELSSLRSQDTAVYYCARG GDYVWGSYRPYYYYYGMDVWGQGTTVTVSSAS TKGPSVFPLAPSSKSTSGGTAALGCLVKDYFPEPV TVSWNSGALTSGVHTFPAVLQSSGLYSLSSVVTVP SSSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 613 |
| iPS:361127 | 5G12.006.001 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2027 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG AGGTCAAGTTCAACTGGTACGTGGACGGCGTGG AGGTGCATAATGCCAAGACAAAGCCGTGTGAGG AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | CCTTCTTCCTCTATAGCAAGCTCACCGTGGACAA GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2184 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 457 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTKVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 614 |
| iPS:361136 | 5G12.006.002 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2028 | CAGGTGCAGTTGGTGGAGTCTGGGGGAGGCGTG GTCCAGCCTGGGAGGTCCCTGAGACTCTCCTGT ACAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG AGGTCAAGTTCAACTGGTACGTGGACGGCGTGG AGGTGCATAATGCCAAGACAAAGCCGTGTGAGG AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT CCTTCTTCCTCTATAGCAAGCTCACCGTGGACAA GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2185 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 458 | QVQLVESGGGVVQPGRSLRLSCTASGFTFSSYGIH WVRQAPGKGLEWVAVIWYDASNKFHADAVKGR FTISRDNSKNTLYLQMNSLRAEDSAMYFCARGKV AGMPEAFEIWGQGTKVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | LTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO: 615 |
| iPS:361140 | 5G12.006.003 | NA | GACATCCAGCTGACCCAGTCTCCATCCTCCCTGTCTGCATCTGTAGGAGACAGAGTCACTATCACTTGCCGGGCAAGTCAGACCATTAGCAGGTTTTTAAATTGGTATCAGCAGAAACCTGGGAAAGCCCCTGAGCTCCTGATCTATGTTGCATCCAGTTTGCAAAGTGGGGTCCCATCAAGATTCAGTGGCAGTGGTTCTGGGACAGATTTCACTCTCACCATCAGCAGTCTGCAACCTGAAGATTTTGCAACTTACTACTGTCAACAGAGTTACAGTACCCTGATCAGTTTTGGCCAGGGGACCAAGCTGGAGATCACACGAACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT SEQ ID NO: 2029 | CAGGTGCAGTTGGTGGAGTCTGGGGGAGGCGTGGTCCAGCCTGGGAGGTCCCTGAGACTCTCCTGTGCAGCGTCTGGATTCACCTTCAGTAGCTATGGCATACACTGGGTCCGCCAGGCTCCAGGCAAGGGGCTGGAGTGGGTGGCAGTTATATGGTATGATGCAAGTAATAAGTTCCATGCAGACGCCGTGAAGGGCCGATTCACCATCTCCAGAGACAATTCCAAGAACACGCTGTATCTGCAAATGAACAGCCTGAGAGCCGAGGACTCGGCTATGTACTTCTGTGCGAGAGGAAAAGTGGCTGGTATGCCTGAAGCTTTTGAAATCTGGGGCCAAGGGACAAAGGTCACCGTCTCTTCAGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGTGTGAGGAGCAGTACGGCAGCACGTACCGTTGTGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA SEQ ID NO: 2186 |
| | | AA | DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC SEQ ID NO: 459 | QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK SEQ ID NO: 616 |
| iPS:359919 | 5G12.006.004 | NA | GACATCCAGCTGACCCAGTCTCCATCCTCCCTGTCTGCATCTGTAGGAGACAGAGTCACTATCACTTGCCGGGCAAGTCAGACCATTAGCAGGTTTTTAAATTGGTATCAGCAGAAACCTGGGAAAGCCCCTAAGCTCCTGATCTATGTTGCATCCAGTTTGCAAAGTGGGGTCCCATCAAGATTCAGTGGCAGTGGTTCTGGGACAGATTTCACTCTCACCATCAGCAGTCTGCAACCTGAAGATTTTGCAACTTACTACTGTCAACAGAGTTACAGTACCCTGATCAGTTTTGGCCA | CAGGTGCAGTTGGTGGAGTCTGGGGGAGGCGTGGTCCAGCCTGGGAGGTCCCTGAGACTCTCCTGTGCAGCGTCTGGATTCACCTTCAGTAGCTATGGCATACACTGGGTCCGCCAGGCTCCAGGCAAGGGGCTGGAGTGGGTGGCAGTTATATGGTATGATGCAAGTAATAAGTTCCATGCAGACGCCGTGAAGGGCCGATTCACCATCTCCAGAGACAATTCCAAGAACACGCTGTATCTGCAAATGAACAGCCTGAGAGCCGAGGACTCGGCTATGTACTTCTGTGCGAGAGGA |

TABLE 5-continued

| iPS# | Ab | Type | LC | HC |
|---|---|---|---|---|
| | | | GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2030 | AAAGTGGCTGGTATGCCTGAAGCTTTTGAAATC TGGGGCCAAGGGACATTGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG AGGTCAAGTTCAACTGGTACGTGGACGGCGTGG AGGTGCATAATGCCAAGACAAAGCCGTGTGAGG AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT CCTTCTTCCTCTATAGCAAGCTCACCGTGGACAA GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2187 |
| | | AA | DIQLTQSPSSLSASVGDRVTITCRASQTISRFLNWY QQKPGKAPKLLIYVASSLQSGVPSRFSGSGSGTDF TLTISSLQPEDFATYYCQQSYSTLISFGQGTKLEIK RTVAAPSVFIFPPSDEQLKSGTASVVCLLNNFYPRE AKVQWKVDNALQSGNSQESVTEQDSKDSTYSLSST LTLSKADYEKHKVYACEVTHQGLSSPVTKSFNRG EC SEQ ID NO: 460 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 617 |
| iPS:361144 | 5G12.006.005 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2031 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACTCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG |

Exemplary Light and Heavy Chain Nucleic Acid ("NA") and Amino Acid ("AA") Sequences TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | AGGTCAAGTTCAACTGGTACGTGGACGGCGTGG AGGTGCATAATGCCAAGACAAAGCCGTGTGAGG AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT CCTTCTTCCTCTATAGCAAGCTCACCGTGGACAA GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2188 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 461 | QVQLVESGGGVVQPGRSLRLSCAASGFTFSSYGIH WVRQAPGKGLEWVAVIWYDASNKFHADSVKGRF TISRDNSKNTLYLQMNSLRAEDSAMYFCARGKVA GMPEAFEIWGQGTKVTVSSASTKGPSVFPLAPSSK STSGGTAALGCLVKDYFPEPVTVSWNSGALTSGV HTFPAVLQSSGLYSLSSVVTVPSSSLGTQTYICNVN HKPSNTKVDKKVEPKSCDKTHTCPPCPAPELLGGP SVFLFPPKPKDTLMISRTPEVTCVVVDVSHEDPEV KFNWYVDGVEVHNAKTKPCEEQYGSTYRCVSVL TVLHQDWLNGKEYKCKVSNKALPAPIEKTISKAK GQPREPQVYTLPPSREEMTKNQVSLTCLVKGFYPS DIAVEWESNGQPENNYKTTPPVLDSDGSFFLYSKL TVDKSRWQQGNVFSCSVMHEALHNHYTQKSLSL SPGK SEQ ID NO: 618 |
| iPS:361151 | 5G12.006.006 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTG AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGATCAGTTTTGGCCA GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2032 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGGA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACAAAGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG AGGTCAAGTTCAACTGGTACGTGGACGGCGTGG AGGTGCATAATGCCAAGACAAAGCCGTGTGAGG AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT CCTTCTTCCTCTATAGCAAGCTCACCGTGGACAA |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | | GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2189 |
| | | AA | DIQLTQSPSSLSASVGDRVTITCRASQTISRFLNWY QQKPGKAPELLIYVASSLQSGVPSRFSGSGSGTDFT LTISSLQPEDFATYYCQQSYSTLISFGQGTKLEIKR TVAAPSVFIFPPSDEQLKSGTASVVCLLNNFYPREA KVQWKVDNALQSGNSQESVTEQDSKDSTYSLSST LTLSKADYEKHKVYACEVTHQGLSSPVTKSFNRG EC SEQ ID NO: 462 | QVQLVESGGGVVQPGRSLRLSCAASGFTFSSYGIH WVRQAPGKGLEWVAVIWYDGSNKFHADAVKGR FTISRDNSKNTLYLQMNSLRAEDSAMYFCARGKV AGMPEAFEIWGQGTKVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 619 |
| iPS:361491 | 17B11.002.001 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG TCAGCCCAAGGCTGCCCCCTCGGTCACTCTGTTC CCGCCCTCCTCTGAGGAGCTTCAAGCCAACAAG GCCACACTGGTGTGTCTCATAAGTGACTTCTACC CGGGAGCCGTGACAGTGGCCTGGAAGGCAGAT AGCAGCCCCGTCAAGGCGGGAGTGGAGACCAC CACACCCTCCAAACAAAGCAACAACAAGTACGC GGCCAGCAGCTATCTGAGCCTGACGCCTGAGCA GTGGAAGTCCCACAGAAGCTACAGCTGCCAGGT CACGCATGAAGGGAGCACCGTGGAGAAGACAG TGGCCCCTACAGAATGTTCA SEQ ID NO: 2033 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCAGCCTCCACCA AGGGCCCATCGGTCTTCCCCCTGGCACCCTCCTC CAAGAGCACCTCTGGGGGCACAGCGGCCCTGGG CTGCCTGGTCAAGGACTACTTCCCCGAACCGGT GACGGTGTCGTGGAACTCAGGCGCCCTGACCAG CGGCGTGCACACCTTCCCGGCTGTCCTACAGTCC TCAGGACTCTACTCCCTCAGCAGCGTGGTGACC GTGCCCTCCAGCAGCTTGGGCACCCAGACCTAC ATCTGCAACGTGAATCACAAGCCCAGCAACACC AAGGTGGACAAGAAAGTTGAGCCCAAATCTTGT GACAAAACTCACACATGCCCACCGTGCCCAGCA CCTGAACTCCTGGGGGGACCGTCAGTCTTCCTCT TCCCCCCAAAACCCAAGGACACCCTCATGATCT CCCGGACCCCTGAGGTCACATGCGTGGTGGTGG ACGTGAGCCACGAAGACCCTGAGGTCAAGTTCA ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA GCAGGGGAACGTCTTCTCATGCTCCGTGATGCA TGAGGCTCTGCACAACCACTACACGCAGAAGAG CCTCTCCCTGTCTCCGGGTAAA SEQ ID NO: 2190 |
| | | AA | QSVLTQPPSVSAAPGQKVTISCSGSSSNIGNNYVS WYQQLPGTAPKLLIYDNNKRPSGIPDRFSGSKSGT SATLGITGLQTGDEADYYCGTWDSSLSAVVFGGG TKLTVLGQPKAAPSVTLFPPSSEELQANKATLVCLI SDFYPGAVTVAWKADSSPVKAGVETTTPSKQSNN KYAASSYLSLTPEQWKSHRSYSCQVTHEGSTVEK TVAPTECS SEQ ID NO: 463 | QMQLVQSGAEVKKPGASVKVSCKASGYTFTSYDI NWVRQATGQGLEWMGWMNPNSGGTGYAQKFQ GRVTMTRDTSISTAYMELSSLRSQDTAVYYCARG GDYVWGSYRPYYYYYGMDVWGQGTTVTVSSAS TKGPSVFPLAPSSKSTSGGTAALGCLVKDYFPEPV TVSWNSGALTSGVHTFPAVLQSSGLYSLSSVVTVP SSSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK |

TABLE 5-continued

| iPS# | Ab | Type | LC | HC |
|---|---|---|---|---|
| Exemplary Light and Heavy Chain Nucleic Acid ("NA") and Amino Acid ("AA") Sequences | | | | |
| | | | | ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 620 |
| iPS:361499 | 17B11.002.002 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG TCAGCCCAAGGCTGCCCCCTCGGTCACTCTGTTC CCGCCCTCCTCTGAGGAGCTTCAAGCCAACAAG GCCACACTGGTGTGTCTCATAAGTGACTTCTACC CGGGAGCCGTGACAGTGGCCTGGAAGGCAGAT AGCAGCCCCGTCAAGGCGGGAGTGGAGACCAC CACACCCTCCAAACAAAGCAACAACAAGTACGC GGCCAGCAGCTATCTGAGCCTGACGCCTGAGCA GTGGAAGTCCCACAGAAGCTACAGCTGCCAGGT CACGCATGAAGGGAGCACCGTGGAGAAGACAG TGGCCCCTACAGAATGTTCA SEQ ID NO: 2034 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTAACACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCAGCCTCCACCA AGGGCCCATCGGTCTTCCCCCTGGCACCCTCCTC CAAGAGCACCTCTGGGGGCACAGCGGCCCTGGG CTGCCTGGTCAAGGACTACTTCCCCGAACCGGT GACGGTGTCGTGGAACTCAGGCGCCCTGACCAG CGGCGTGCACACCTTCCCGGCTGTCCTACAGTCC TCAGGACTCTACTCCCTCAGCAGCGTGGTGACC GTGCCCTCCAGCAGCTTGGGCACCCAGACCTAC ATCTGCAACGTGAATCACAAGCCCAGCAACACC AAGGTGGACAAGAAAGTTGAGCCCAAATCTTGT GACAAAACTCACACATGCCCACCGTGCCCAGCA CCTGAACTCCTGGGGGGACCGTCAGTCTTCCTCT TCCCCCCAAAACCCAAGGACACCCTCATGATCT CCCGGACCCCTGAGGTCACATGCGTGGTGGTGG ACGTGAGCCACGAAGACCCTGAGGTCAAGTTCA ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA GCAGGGGAACGTCTTCTCATGCTCCGTGATGCA TGAGGCTCTGCACAACCACTACACGCAGAAGAG CCTCTCCCTGTCTCCGGGTAAA SEQ ID NO: 2191 |
| | | AA | QSVLTQPPSVSAAPGQKVTISCSGSSSNIGNNYVS WYQQLPGTAPKLLIYDNNKRPSGIPDRFSGSKSGT SATLGITGLQTGDEADYYCGTWDSSLSAVVFGGG TKLTVLGQPKAAPSVTLFPPSSEELQANKATLVCLI SDFYPGAVTVAWKADSSPVKAGVETTTPSKQSNN KYAASSYLSLTPEQWKSHRSYSCQVTHEGSTVEK TVAPTECS SEQ ID NO: 464 | QMQLVQSGAEVKKPGASVKVSCKASGYTFTSYDI NWVRQATGQGLEWMGWMNPNSGNTGYAQKFQ GRVTMTRDTSISTAYMELSSLRSQDTAVYYCARG GDYVWGSYRPYYYYYGMDVWGQGTTVTVSSAS TKGPSVFPLAPSSKSTSGGTAALGCLVKDYFPEPV TVSWNSGALTSGVHTFPAVLQSSGLYSLSSVVTVP SSSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 621 |
| iPS:361503 | 17B11.002.003 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATGAGCAGTTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGGCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | TCAGCCCAAGGCTGCCCCCTCGGTCACTCTGTTC<br>CCGCCCTCCTCTGAGGAGCTTCAAGCCAACAAG<br>GCCACACTGGTGTGTCTCATAAGTGACTTCTACC<br>CGGGAGCCGTGACAGTGGCCTGGAAGGCAGAT<br>AGCAGCCCCGTCAAGGCGGGAGTGGAGACCAC<br>CACACCCTCCAAACAAAGCAACAACAAGTACGC<br>GGCCAGCAGCTATCTGAGCCTGACGCCTGAGCA<br>GTGGAAGTCCCACAGAAGCTACAGCTGCCAGGT<br>CACGCATGAAGGGAGCACCGTGGAGAAGACAG<br>TGGCCCCTACAGAATGTTCA<br>SEQ ID NO: 2035 | ACTACTACTACGGTATGGACGTCTGGGGCCAAG<br>GGACCACGGTCACCGTCTCCTCAGCCTCCACCA<br>AGGGCCCATCGGTCTTCCCCCTGGCACCCTCCTC<br>CAAGAGCACCTCTGGGGGCACAGCGGCCCTGGG<br>CTGCCTGGTCAAGGACTACTTCCCCGAACCGGT<br>GACGGTGTCGTGGAACTCAGGCGCCCTGACCAG<br>CGGCGTGCACACCTTCCCGGCTGTCCTACAGTCC<br>TCAGGACTCTACTCCCTCAGCAGCGTGGTGACC<br>GTGCCCTCCAGCAGCTTGGGCACCCAGACCTAC<br>ATCTGCAACGTGAATCACAAGCCCAGCAACACC<br>AAGGTGGACAAGAAAGTTGAGCCCAAATCTTGT<br>GACAAAACTCACACATGCCCACCGTGCCCAGCA<br>CCTGAACTCCTGGGGGGACCGTCAGTCTTCCTCT<br>TCCCCCCAAAACCCAAGGACACCCTCATGATCT<br>CCCGGACCCCTGAGGTCACATGCGTGGTGGTGG<br>ACGTGAGCCACGAAGACCCTGAGGTCAAGTTCA<br>ACTGGTACGTGGACGGCGTGGAGGTGCATAATG<br>CCAAGACAAAGCCGTGTGAGGAGCAGTACGGC<br>AGCACGTACCGTTGTGTCAGCGTCCTCACCGTCC<br>TGCACCAGGACTGGCTGAATGGCAAGGAGTACA<br>AGTGCAAGGTCTCCAACAAAGCCCTCCCAGCCC<br>CCATCGAGAAAACCATCTCCAAAGCCAAAGGGC<br>AGCCCCGAGAACCACAGGTGTACACCCTGCCCC<br>CATCCCGGGAGGAGATGACCAAGAACCAGGTC<br>AGCCTGACCTGCCTGGTCAAAGGCTTCTATCCC<br>AGCGACATCGCCGTGGAGTGGGAGAGCAATGG<br>GCAGCCGGAGAACAACTACAAGACCACGCCTCC<br>CGTGCTGGACTCCGACGGCTCCTTCTTCCTCTAT<br>AGCAAGCTCACCGTGGACAAGAGCAGGTGGCA<br>GCAGGGGAACGTCTTCTCATGCTCCGTGATGCA<br>TGAGGCTCTGCACAACCACTACACGCAGAAGAG<br>CCTCTCCCTGTCTCCGGGTAAA<br>SEQ ID NO: 2192 |
| | | AA | QSVLTQPPSVSAAPGQKVTISCSGSSSNIGNNYVS<br>WYEQFPGTAPKLLIYDNNKRPSGIPDRFSGSKSGTS<br>ATLGITGLQTGDEADYYCGTWDSSLSAVVFGGGT<br>KLTVLGQPKAAPSVTLFPPSSEELQANKATLVCLIS<br>DFYPGAVTVAWKADSSPVKAGVETTTPSKQSNNK<br>YAASSYLSLTPEQWKSHRSYSCQVTHEGSTVEKT<br>VAPTECS<br>SEQ ID NO: 465 | QMQLVQSGAEVKKPGASVKVSCKASGYTFTSYDI<br>NWVRQATGQGLEWMGWMNPNSGGTGYAQKFQ<br>GRVTMTRDTSISTAYMELSSLRSQDTAVYYCARG<br>GDYVWGSYRPYYYYYGMDVWGQGTTVTVSSAS<br>TKGPSVFPLAPSSKSTSGGTAALGCLVKDYFPEPV<br>TVSWNSGALTSGVHTFPAVLQSSGLYSLSSVVTVP<br>SSSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 622 |
| iPS:361507 | 17B11.002.004 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGCCATCACCGG<br>ACTCCAGACTGGGGACGAGGCCGATTATTACTG<br>CGGAACATTCGAAAGCAGCCTGAGTGCTGTGGT<br>ATTCGGCGGAGGGACCAAACTGACCGTCCTAGG<br>TCAGCCCAAGGCTGCCCCCTCGGTCACTCTGTTC<br>CCGCCCTCCTCTGAGGAGCTTCAAGCCAACAAG<br>GCCACACTGGTGTGTCTCATAAGTGACTTCTACC<br>CGGGAGCCGTGACAGTGGCCTGGAAGGCAGAT<br>AGCAGCCCCGTCAAGGCGGGAGTGGAGACCAC<br>CACACCCTCCAAACAAAGCAACAACAAGTACGC<br>GGCCAGCAGCTATCTGAGCCTGACGCCTGAGCA<br>GTGGAAGTCCCACAGAAGCTACAGCTGCCAGGT<br>CACGCATGAAGGGAGCACCGTGGAGAAGACAG<br>TGGCCCCTACAGAATGTTCA<br>SEQ ID NO: 2036 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCCCTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>GACGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCAGCCTCCACCA<br>AGGGCCCATCGGTCTTCCCCCTGGCACCCTCCTC<br>CAAGAGCACCTCTGGGGGCACAGCGGCCCTGGG<br>CTGCCTGGTCAAGGACTACTTCCCCGAACCGGT<br>GACGGTGTCGTGGAACTCAGGCGCCCTGACCAG<br>CGGCGTGCACACCTTCCCGGCTGTCCTACAGTCC<br>TCAGGACTCTACTCCCTCAGCAGCGTGGTGACC<br>GTGCCCTCCAGCAGCTTGGGCACCCAGACCTAC<br>ATCTGCAACGTGAATCACAAGCCCAGCAACACC<br>AAGGTGGACAAGAAAGTTGAGCCCAAATCTTGT<br>GACAAAACTCACACATGCCCACCGTGCCCAGCA<br>CCTGAACTCCTGGGGGGACCGTCAGTCTTCCTCT<br>TCCCCCCAAAACCCAAGGACACCCTCATGATCT<br>CCCGGACCCCTGAGGTCACATGCGTGGTGGTGG<br>ACGTGAGCCACGAAGACCCTGAGGTCAAGTTCA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA GCAGGGGAACGTCTTCTCATGCTCCGTGATGCA TGAGGCTCTGCACAACCACTACACGCAGAAGAG CCTCTCCCTGTCTCCGGGTAAA SEQ ID NO: 2193 |
| | | AA | QSVLTQPPSVSAAPGQKVTISCSGSSSNIGNNYVS WYQQLPGTAPKLLIYDNNKRPSGIPDRFSGSKSGT SATLAITGLQTGDEADYYCGTFESSLSAVVFGGGT KLTVLGQPKAAPSVTLFPPSSEELQANKATLVCLIS DFYPGAVTVAWKADSSPVKAGVETTTPSKQSNNK YAASSYLSLTPEQWKSHRSYSCQVTHEGSTVEKT VAPTECS SEQ ID NO: 466 | QMQLVQSGAEVKKPGASVKVSCKASGYTFTSYDI NWVRQAPGQGLEWMGWMNPNSGGTGYAQKFQ GRVTMTRDTSISTAYMELSSLRSDDTAVYYCARG GDYVWGSYRPYYYYYGMDVWGQGTTVTVSSAS TKGPSVFPLAPSSKSTSGGTAALGCLVKDYFPEPV TVSWNSGALTSGVHTFPAVLQSSGLYSLSSVVTVP SSSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 623 |
| iPS:361514 | 17B11.002.005 | NA | CAGTCTGTGTTGACGCAGCCGCCCTCAGTGTCTG CGGCCCCAGGACAGAAGGTCACCATCTCCTGCT CTGGAAGCAGCTCCAACATTGGAAATAATTATG TATCCTGGTATCAGCAGCTCCCAGGAACAGCCC CCAAACTCCTCATTTATGACAATAATAAGCGAC CCTCAGGGATTCCTGACCGATTCTCTGGCTCCAA GTCTGGCACGTCAGCCACCCTGGCCATCACCGG ACTCCAGACTGGGGACGAGGCCGATTATTACTG CGGAACATGGGATAGCAGCCTGAGTGCTGTGGT ATTCGGCGGAGGGACCAAACTGACCGTCCTAGG TCAGCCCAAGGCTGCCCCCTCGGTCACTCTGTTC CCGCCCTCCTCTGAGGAGCTTCAAGCCAACAAG GCCACACTGGTGTGTCTCATAAGTGACTTCTACC CGGGAGCCGTGACAGTGGCCTGGAAGGCAGAT AGCAGCCCCGTCAAGGCGGGAGTGGAGACCAC CACACCCTCCAAACAAAGCAACAACAAGTACGC GGCCAGCAGCTATCTGAGCCTGACGCCTGAGCA GTGGAAGTCCCACAGAAGCTACAGCTGCCAGGT CACGCATGAAGGGAGCACCGTGGAGAAGACAG TGGCCCCTACAGAATGTTCA SEQ ID NO: 2037 | CAAATGCAGCTGGTGCAGTCTGGGGCTGAGGTG AAGAAGCCTGGGGCCTCAGTGAAGGTCTCCTGC AAGGCTTCTGGATACACCTTCACCAGTTATGAT ATCAACTGGGTGCGACAGGCCACTGGACAAGGG CTTGAGTGGATGGGATGGATGAACCCTAACAGT GGTGGCACAGGCTATGCACAGAAGTTCCAGGGC AGAGTCACCATGACCAGGGACACCTCCATAAGC ACAGCCTACATGGAGCTGAGCAGCCTGAGATCT CAGGACACGGCCGTGTATTACTGTGCGAGAGGG GGTGATTACGTTTGGGGGAGTTATCGTCCCTACT ACTACTACTACGGTATGGACGTCTGGGGCCAAG GGACCACGGTCACCGTCTCCTCAGCCTCCACCA AGGGCCCATCGGTCTTCCCCCTGGCACCCTCCTC CAAGAGCACCTCTGGGGGCACAGCGGCCCTGGG CTGCCTGGTCAAGGACTACTTCCCCGAACCGGT GACGGTGTCGTGGAACTCAGGCGCCCTGACCAG CGGCGTGCACACCTTCCCGGCTGTCCTACAGTCC TCAGGACTCTACTCCCTCAGCAGCGTGGTGACC GTGCCCTCCAGCAGCTTGGGCACCCAGACCTAC ATCTGCAACGTGAATCACAAGCCCAGCAACACC AAGGTGGACAAGAAAGTTGAGCCCAAATCTTGT GACAAAACTCACACATGCCCACCGTGCCCAGCA CCTGAACTCCTGGGGGGACCGTCAGTCTTCCTCT TCCCCCCAAAACCCAAGGACACCCTCATGATCT CCCGGACCCCTGAGGTCACATGCGTGGTGGTGG ACGTGAGCCACGAAGACCCTGAGGTCAAGTTCA ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | GCAGGGGAACGTCTTCTCATGCTCCGTGATGCA<br>TGAGGCTCTGCACAACCACTACACGCAGAAGAG<br>CCTCTCCCTGTCTCCGGGTAAA<br>SEQ ID NO: 2194 |
| | | AA | QSVLTQPPSVSAAPGQKVTISCSGSSSNIGNNYVS<br>WYQQLPGTAPKLLIYDNNKRPSGIPDRFSGSKSGT<br>SATLAITGLQTGDEADYYCGTWDSSLSAVVFGGG<br>TKLTVLGQPKAAPSVTLFPPSSEELQANKATLVCLI<br>SDFYPGAVTVAWKADSSPVKAGVETTTPSKQSNN<br>KYAASSYLSLTPEQWKSHRSYSCQVTHEGSTVEK<br>TVAPTECS<br>SEQ ID NO: 467 | QMQLVQSGAEVKKPGASVKVSCKASGYTFTSYDI<br>NWVRQATGQGLEWMGWMNPNSGGTGYAQKFQ<br>GRVTMTRDTSISTAYMELSSLRSQDTAVYYCARG<br>GDYVWGSYRPYYYYYGMDVWGQGTTVTVSSAS<br>TKGPSVFPLAPSSKSTSGGTAALGCLVKDYFPEPV<br>TVSWNSGALTSGVHTFPAVLQSSGLYSLSSVVTVP<br>SSSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 624 |
| iPS:360582 | 17B11.002.006 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGCCATCACCGG<br>ACTCCAGACTGGGGACGAGGCCGATTATTACTG<br>CGGAACATGGGATAGCAGCCTGAGTGCTGTGGT<br>ATTCGGCGGAGGGACCAAACTGACCGTCCTAGG<br>TCAGCCCAAGGCTGCCCCCTCGGTCACTCTGTTC<br>CCGCCCTCCTCTGAGGAGCTTCAAGCCAACAAG<br>GCCACACTGGTGTGTCTCATAAGTGACTTCTACC<br>CGGGAGCCGTGACAGTGGCCTGGAAGGCAGAT<br>AGCAGCCCCGTCAAGGCGGGAGTGGAGACCAC<br>CACACCCTCCAAACAAAGCAACAACAAGTACGC<br>GGCCAGCAGCTATCTGAGCCTGACGCCTGAGCA<br>GTGGAAGTCCCACAGAAGCTACAGCTGCCAGGT<br>CACGCATGAAGGGAGCACCGTGGAGAAGACAG<br>TGGCCCCTACAGAATGTTCA<br>SEQ ID NO: 2038 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCCCTGGACAAGGG<br>CTTGAGTGGATGGGATGGATGAACCCTAACAGT<br>GGTAACACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>GACGACACGGCCGTGTATTACTGTGCGAGAGGG<br>GGTGATTACGTTTGGGGGAGTTATCGTCCCTACT<br>ACTACTACTACGGTATGGACGTCTGGGGCCAAG<br>GGACCACGGTCACCGTCTCCTCAGCCTCCACCA<br>AGGGCCCATCGGTCTTCCCCCTGGCACCCTCCTC<br>CAAGAGCACCTCTGGGGGCACAGCGGCCCTGGG<br>CTGCCTGGTCAAGGACTACTTCCCCGAACCGGT<br>GACGGTGTCGTGGAACTCAGGCGCCCTGACCAG<br>CGGCGTGCACACCTTCCCGGCTGTCCTACAGTCC<br>TCAGGACTCTACTCCCTCAGCAGCGTGGTGACC<br>GTGCCCTCCAGCAGCTTGGGCACCCAGACCTAC<br>ATCTGCAACGTGAATCACAAGCCCAGCAACACC<br>AAGGTGGACAAGAAAGTTGAGCCCAAATCTTGT<br>GACAAAACTCACACATGCCCACCGTGCCCAGCA<br>CCTGAACTCCTGGGGGGACCGTCAGTCTTCCTCT<br>TCCCCCCAAAACCCAAGGACACCCTCATGATCT<br>CCCGGACCCCTGAGGTCACATGCGTGGTGGTGG<br>ACGTGAGCCACGAAGACCCTGAGGTCAAGTTCA<br>ACTGGTACGTGGACGGCGTGGAGGTGCATAATG<br>CCAAGACAAAGCCGTGTGAGGAGCAGTACGGC<br>AGCACGTACCGTTGTGTCAGCGTCCTCACCGTCC<br>TGCACCAGGACTGGCTGAATGGCAAGGAGTACA<br>AGTGCAAGGTCTCCAACAAAGCCCTCCCAGCCC<br>CCATCGAGAAAACCATCTCCAAAGCCAAAGGGC<br>AGCCCCGAGAACCACAGGTGTACACCCTGCCCC<br>CATCCCGGGAGGAGATGACCAAGAACCAGGTC<br>AGCCTGACCTGCCTGGTCAAAGGCTTCTATCCC<br>AGCGACATCGCCGTGGAGTGGGAGAGCAATGG<br>GCAGCCGGAGAACAACTACAAGACCACGCCTCC<br>CGTGCTGGACTCCGACGGCTCCTTCTTCCTCTAT<br>AGCAAGCTCACCGTGGACAAGAGCAGGTGGCA<br>GCAGGGGAACGTCTTCTCATGCTCCGTGATGCA<br>TGAGGCTCTGCACAACCACTACACGCAGAAGAG<br>CCTCTCCCTGTCTCCGGGTAAA<br>SEQ ID NO: 2195 |
| | | AA | QSVLTQPPSVSAAPGQKVTISCSGSSSNIGNNYVS<br>WYQQLPGTAPKLLIYDNNKRPSGIPDRFSGSKSGT<br>SATLAITGLQTGDEADYYCGTWDSSLSAVVFGGG<br>TKLTVLGQPKAAPSVTLFPPSSEELQANKATLVCLI<br>SDFYPGAVTVAWKADSSPVKAGVETTTPSKQSNN<br>KYAASSYLSLTPEQWKSHRSYSCQVTHEGSTVEK<br>TVAPTECS<br>SEQ ID NO: 468 | QMQLVQSGAEVKKPGASVKVSCKASGYTFTSYDI<br>NWVRQAPGQGLEWMGWMNPNSGNTGYAQKFQ<br>GRVTMTRDTSISTAYMELSSLRSDDTAVYYCARG<br>GDYVWGSYRPYYYYYGMDVWGQGTTVTVSSAS<br>TKGPSVFPLAPSSKSTSGGTAALGCLVKDYFPEPV<br>TVSWNSGALTSGVHTFPAVLQSSGLYSLSSVVTVP<br>SSSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 625 |
| iPS:361518 | 17B11.002.007 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGGCATCACCGG<br>ACTCCAGACTGGGGACGAGGCCGATTATTACTG<br>CGGAACATGGGATAGCAGCCTGAGTGCTGTGGT<br>ATTCGGCGGAGGGACCAAACTGACCGTCCTAGG<br>TCAGCCCAAGGCTGCCCCCTCGGTCACTCTGTTC<br>CCGCCCTCCTCTGAGGAGCTTCAAGCCAACAAG<br>GCCACACTGGTGTGTCTCATAAGTGACTTCTACC<br>CGGGAGCCGTGACAGTGGCCTGGAAGGCAGAT<br>AGCAGCCCCGTCAAGGCGGGAGTGGAGACCAC<br>CACACCCTCCAAACAAAGCAACAACAAGTACGC<br>GGCCAGCAGCTATCTGAGCCTGACGCCTGAGCA<br>GTGGAAGTCCCACAGAAGCTACAGCTGCCAGGT<br>CACGCATGAAGGGAGCACCGTGGAGAAGACAG<br>TGGCCCCTACAGAATGTTCA<br>SEQ ID NO: 2039 | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCACTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>CAGGACACGGCCGTGTATTACTGTGCGAGAGGG<br>GGTGATTACGTTTTCGGGAGTTATCGTCCCTACT<br>ACTACTACTACGGTATGGACGTCTGGGGCCAAG<br>GGACCACGGTCACCGTCTCCTCAGCCTCCACCA<br>AGGGCCCATCGGTCTTCCCCCTGGCACCCTCCTC<br>CAAGAGCACCTCTGGGGGCACAGCGGCCCTGGG<br>CTGCCTGGTCAAGGACTACTTCCCCGAACCGGT<br>GACGGTGTCGTGGAACTCAGGCGCCCTGACCAG<br>CGGCGTGCACACCTTCCCGGCTGTCCTACAGTCC<br>TCAGGACTCTACTCCCTCAGCAGCGTGGTGACC<br>GTGCCCTCCAGCAGCTTGGGCACCCAGACCTAC<br>ATCTGCAACGTGAATCACAAGCCCAGCAACACC<br>AAGGTGGACAAGAAAGTTGAGCCCAAATCTTGT<br>GACAAAACTCACACATGCCCACCGTGCCCAGCA<br>CCTGAACTCCTGGGGGGACCGTCAGTCTTCCTCT<br>TCCCCCCAAAACCCAAGGACACCCTCATGATCT<br>CCCGGACCCCTGAGGTCACATGCGTGGTGGTGG<br>ACGTGAGCCACGAAGACCCTGAGGTCAAGTTCA<br>ACTGGTACGTGGACGGCGTGGAGGTGCATAATG<br>CCAAGACAAAGCCGTGTGAGGAGCAGTACGGC<br>AGCACGTACCGTTGTGTCAGCGTCCTCACCGTCC<br>TGCACCAGGACTGGCTGAATGGCAAGGAGTACA<br>AGTGCAAGGTCTCCAACAAAGCCCTCCCAGCCC<br>CCATCGAGAAAACCATCTCCAAAGCCAAAGGGC<br>AGCCCCGAGAACCACAGGTGTACACCCTGCCCC<br>CATCCCGGGAGGAGATGACCAAGAACCAGGTC<br>AGCCTGACCTGCCTGGTCAAAGGCTTCTATCCC<br>AGCGACATCGCCGTGGAGTGGGAGAGCAATGG<br>GCAGCCGGAGAACAACTACAAGACCACGCCTCC<br>CGTGCTGGACTCCGACGGCTCCTTCTTCCTCTAT<br>AGCAAGCTCACCGTGGACAAGAGCAGGTGGCA<br>GCAGGGGAACGTCTTCTCATGCTCCGTGATGCA<br>TGAGGCTCTGCACAACCACTACACGCAGAAGAG<br>CCTCTCCCTGTCTCCGGGTAAA<br>SEQ ID NO: 2196 |
| | | AA | QSVLTQPPSVSAAPGQKVTISCSGSSSNIGNNYVS<br>WYQQLPGTAPKWYDNNKRPSGIPDRFSGSKSGT<br>SATLGITGLQTGDEADYYCGTWDSSLSAVVFGGG<br>TKLTVLGQPKAAPSVTLFPPSSEELQANKATLVCLI<br>SDFYPGAVTVAWKADSSPVKAGVETTTPSKQSNN<br>KYAASSYLSLTPEQWKSHRSYSCQVTHEGSTVEK<br>TVAPTECS<br>SEQ ID NO: 469 | QMQLVQSGAEVKKPGASVKVSCKASGYTFTSYDI<br>NWVRQATGQGLEWMGWMNPNSGGTGYAQKFQ<br>GRVTMTRDTSISTAYMELSSLRSQDTAVYYCARG<br>GDYVFGSYRPYYYYYGMDVWGQGTTVTVSSAST<br>KGPSVFPLAPSSKSTSGGTAALGCLVKDYFPEPVT<br>VSWNSGALTSGVHTFPAVLQSSGLYSLSSVVTVPS<br>SSLGTQTYICNVNHKPSNTKVDKKVEPKSCDKTH<br>TCPPCPAPELLGGPSVFLFPPKPKDTLMISRTPEVT<br>CVVVDVSHEDPEVKFNWYVDGVEVHNAKTKPCE<br>EQYGSTYRCVSVLTVLHQDWLNGKEYKCKVSNK<br>ALPAPIEKTISKAKGQPREPQVYTLPPSREEMTKNQ<br>VSLTCLVKGFYPSDIAVEWESNGQPENNYKTTPPV<br>LDSDGSFFLYSKLTVDKSRWQQGNVFSCSVMHEA<br>LHNHYTQKSLSLSPGK<br>SEQ ID NO: 626 |
| iPS:360570 | 17B11.002.008 | NA | CAGTCTGTGTTGACGCAGCCGCCCTCAGTGTCTG<br>CGGCCCCAGGACAGAAGGTCACCATCTCCTGCT<br>CTGGAAGCAGCTCCAACATTGGAAATAATTATG<br>TATCCTGGTATCAGCAGCTCCCAGGAACAGCCC<br>CCAAACTCCTCATTTATGACAATAATAAGCGAC<br>CCTCAGGGATTCCTGACCGATTCTCTGGCTCCAA<br>GTCTGGCACGTCAGCCACCCTGGCCATCACCGG<br>ACTCCAGACTGGGGACGAGGCCGATTATTACTG<br>CGGAACATTCGAAAGCAGCCTGAGTGCTGTGGT<br>ATTCGGCGGAGGGACCAAACTGACCGTCCTAGG<br>TCAGCCCAAGGCTGCCCCCTCGGTCACTCTGTTC | CAAATGCAGCTGGTGCAGTCTGGGGCTGAGGTG<br>AAGAAGCCTGGGGCCTCAGTGAAGGTCTCCTGC<br>AAGGCTTCTGGATACACCTTCACCAGTTATGAT<br>ATCAACTGGGTGCGACAGGCCCCTGGACAAGGG<br>CTTGAGTGGATGGGATGGATGAACCCTAACAGT<br>GGTGGCACAGGCTATGCACAGAAGTTCCAGGGC<br>AGAGTCACCATGACCAGGGACACCTCCATAAGC<br>ACAGCCTACATGGAGCTGAGCAGCCTGAGATCT<br>GACGACACGGCCGTGTATTACTGTGCGAGAGGG<br>GGTGATTACGTTTTCGGGAGTTATCGTCCCTACT<br>ACTACTACTACGGTATGGACGTCTGGGGCCAAG |

TABLE 5-continued

| Exemplary Light and Heavy Chain Nucleic Acid ("NA") and Amino Acid ("AA") Sequences | | | | |
|---|---|---|---|---|
| iPS# | Ab | Type | LC | HC |
| | | | CCGCCCTCCTCTGAGGAGCTTCAAGCCAACAAG GCCACACTGGTGTGTCTCATAAGTGACTTCTACC CGGGAGCCGTGACAGTGGCCTGGAAGGCAGAT AGCAGCCCCGTCAAGGCGGGAGTGGAGACCAC CACACCCTCCAAACAAAGCAACAACAAGTACGC GGCCAGCAGCTATCTGAGCCTGACGCCTGAGCA GTGGAAGTCCCACAGAAGCTACAGCTGCCAGGT CACGCATGAAGGGAGCACCGTGGAGAAGACAG TGGCCCCTACAGAATGTTCA SEQ ID NO: 2040 | GGACCACGGTCACCGTCTCCTCAGCCTCCACCA AGGGCCCATCGGTCTTCCCCCTGGCACCCTCCTC CAAGAGCACCTCTGGGGGCACAGCGGCCCTGGG CTGCCTGGTCAAGGACTACTTCCCCGAACCGGT GACGGTGTCGTGGAACTCAGGCGCCCTGACCAG CGGCGTGCACACCTTCCCGGCTGTCCTACAGTCC TCAGGACTCTACTCCCTCAGCAGCGTGGTGACC GTGCCCTCCAGCAGCTTGGGCACCCAGACCTAC ATCTGCAACGTGAATCACAAGCCCAGCAACACC AAGGTGGACAAGAAAGTTGAGCCCAAATCTTGT GACAAAACTCACACATGCCCACCGTGCCCAGCA CCTGAACTCCTGGGGGGACCGTCAGTCTTCCTCT TCCCCCCAAAACCCAAGGACACCCTCATGATCT CCCGGACCCCTGAGGTCACATGCGTGGTGGTGG ACGTGAGCCACGAAGACCCTGAGGTCAAGTTCA ACTGGTACGTGGACGGCGTGGAGGTGCATAATG CCAAGACAAAGCCGTGTGAGGAGCAGTACGGC AGCACGTACCGTTGTGTCAGCGTCCTCACCGTCC TGCACCAGGACTGGCTGAATGGCAAGGAGTACA AGTGCAAGGTCTCCAACAAAGCCCTCCCAGCCC CCATCGAGAAAACCATCTCCAAAGCCAAAGGGC AGCCCCGAGAACCACAGGTGTACACCCTGCCCC CATCCCGGGAGGAGATGACCAAGAACCAGGTC AGCCTGACCTGCCTGGTCAAAGGCTTCTATCCC AGCGACATCGCCGTGGAGTGGGAGAGCAATGG GCAGCCGGAGAACAACTACAAGACCACGCCTCC CGTGCTGGACTCCGACGGCTCCTTCTTCCTCTAT AGCAAGCTCACCGTGGACAAGAGCAGGTGGCA GCAGGGGAACGTCTTCTCATGCTCCGTGATGCA TGAGGCTCTGCACAACCACTACACGCAGAAGAG CCTCTCCCTGTCTCCGGGTAAA SEQ ID NO: 2197 |
| | | AA | QSVLTQPPSVSAAPGQKVTISCSGSSSNIGNNYVS WYQQLPGTAPKLLIYDNNKRPSGIPDRFSGSKSGT SATLAITGLQTGDEADYYCGTFESSLSAVVFGGGT KLTVLGQPKAAPSVTLFPPSSEELQANKATLVCLIS DFYPGAVTVAWKADSSPVKAGVETTTPSKQSNNK YAASSYLSLTPEQWKSHRSYSCQVTHEGSTVEKT VAPTECS SEQ ID NO: 470 | QMQLVQSGAEVKKPGASVKVSCKASGYTFTSYDI NWVRQAPGQGLEWMGWMNPNSGGTGYAQKFQ GRVTMTRDTSISTAYMELSSLRSDDTAVYYCARG GDYVFGSYRPYYYYYGMDVWGQGTTVTVSSAST KGPSVFPLAPSSKSTSGGTAALGCLVKDYFPEPVT VSWNSGALTSGVHTFPAVLQSSGLYSLSSVVTVPS SSLGTQTYICNVNHKPSNTKVDKKVEPKSCDKTH TCPPCPAPELLGGPSVFLFPPKPKDTLMISRTPEVT CVVVDVSHEDPEVKFNWYVDGVEVHNAKTKPCE EQYGSTYRCVSVLTVLHQDWLNGKEYKCKVSNK ALPAPIEKTISKAKGQPREPQVYTLPPSREEMTKNQ VSLTCLVKGFYPSDIAVEWESNGQPENNYKTTPPV LDSDGSFFLYSKLTVDKSRWQQGNVFSCSVMHEA LHNHYTQKSLSLSPGK SEQ ID NO: 627 |
| iPS:362051 | 5G12.005.001 | NA | GACATCCAGCTGACCCAGTCTCCATCCTCCCTGT CTGCATCTGTAGGAGACAGAGTCACTATCACTT GCCGGGCAAGTCAGACCATTAGCAGGTTTTTAA ATTGGTATCAGCAGAAACCTGGGAAAGCCCCTA AGCTCCTGATCTATGTTGCATCCAGTTTGCAAAG TGGGGTCCCATCAAGATTCAGTGGCAGTGGTTC TGGGACAGATTTCACTCTCACCATCAGCAGTCT GCAACCTGAAGATTTTGCAACTTACTACTGTCA ACAGAGTTACAGTACCCTGCTCAGTTTTGGCCA GGGGACCAAGCTGGAGATCAAACGAACGGTGG CTGCACCATCTGTCTTCATCTTCCCGCCATCTGA TGAGCAGTTGAAATCTGGAACTGCCTCTGTTGT GTGCCTGCTGAATAACTTCTATCCCAGAGAGGC CAAAGTACAGTGGAAGGTGGATAACGCCCTCCA ATCGGGTAACTCCCAGGAGAGTGTCACAGAGCA GGACAGCAAGGACAGCACCTACAGCCTCAGCA GCACCCTGACGCTGAGCAAAGCAGACTACGAGA AACACAAAGTCTACGCCTGCGAAGTCACCCATC AGGGCCTGAGCTCGCCCGTCACAAAGAGCTTCA ACAGGGGAGAGTGT SEQ ID NO: 2041 | CAGGTGCAGTTGGTGGAGTCTGGGGGAGGCGTG GTCCAGCCTGGGAGGTCCCTGAGACTCTCCTGT GCAGCGTCTGGATTCACCTTCAGTAGCTATGGC ATACACTGGGTCCGCCAGGCTCCAGGCAAGGGG CTGGAGTGGGTGGCAGTTATATGGTATGATGCA AGTAATAAGTTCCATGCAGACGCCGTGAAGGGC CGATTCACCATCTCCAGAGACAATTCCAAGAAC ACGCTGTATCTGCAAATGAACAGCCTGAGAGCC GAGGACTCGGCTATGTACTTCTGTGCGAGAGGA AAAGTGGCTGGTATGCCTGAAGCTTTTGAAATC TGGGGCCAAGGGACATTGGTCACCGTCTCTTCA GCCTCCACCAAGGGCCCATCGGTCTTCCCCCTG GCACCCTCCTCCAAGAGCACCTCTGGGGGCACA GCGGCCCTGGGCTGCCTGGTCAAGGACTACTTC CCCGAACCGGTGACGGTGTCGTGGAACTCAGGC GCCCTGACCAGCGGCGTGCACACCTTCCCGGCT GTCCTACAGTCCTCAGGACTCTACTCCCTCAGCA GCGTGGTGACCGTGCCCTCCAGCAGCTTGGGCA CCCAGACCTACATCTGCAACGTGAATCACAAGC CCAGCAACACCAAGGTGGACAAGAAAGTTGAG CCCAAATCTTGTGACAAAACTCACACATGCCCA CCGTGCCCAGCACCTGAACTCCTGGGGGGACCG TCAGTCTTCCTCTTCCCCCCAAAACCCAAGGACA CCCTCATGATCTCCCGGACCCCTGAGGTCACAT GCGTGGTGGTGGACGTGAGCCACGAAGACCCTG AGGTCAAGTTCAACTGGTACGTGGACGGCGTGG AGGTGCATAATGCCAAGACAAAGCCGTGTGAGG |

TABLE 5-continued

Exemplary Light and Heavy Chain Nucleic Acid ("NA") and Amino Acid ("AA") Sequences

| iPS# | Ab | Type | LC | HC |
|---|---|---|---|---|
| | | | | AGCAGTACGGCAGCACGTACCGTTGTGTCAGCG TCCTCACCGTCCTGCACCAGGACTGGCTGAATG GCAAGGAGTACAAGTGCAAGGTCTCCAACAAA GCCCTCCCAGCCCCCATCGAGAAAACCATCTCC AAAGCCAAAGGGCAGCCCCGAGAACCACAGGT GTACACCCTGCCCCCATCCCGGGAGGAGATGAC CAAGAACCAGGTCAGCCTGACCTGCCTGGTCAA AGGCTTCTATCCCAGCGACATCGCCGTGGAGTG GGAGAGCAATGGGCAGCCGGAGAACAACTACA AGACCACGCCTCCCGTGCTGGACTCCGACGGCT CCTTCTTCCTCTATAGCAAGCTCACCGTGGACAA GAGCAGGTGGCAGCAGGGGAACGTCTTCTCATG CTCCGTGATGCATGAGGCTCTGCACAACCACTA CACGCAGAAGAGCCTCTCCCTGTCTCCGGGTAA A SEQ ID NO: 2198 |
| | | AA | DIQLTQSPSSLSASVGDRVTITCRASQTISRFLNWY QQKPGKAPKLLIYVASSLQSGVPSRFSGSGSGTDF TLTISSLQPEDFATYYCQQSYSTLLSFGQGTKLEIK RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSSPVTKSFNR GEC SEQ ID NO: 471 | QVQLVESGGGVVQPGRSLRLSCAASGFTFSSYGIH WVRQAPGKGLEWVAVIWYDASNKFHADAVKGR FTISRDNSKNTLYLQMNSLRAEDSAMYFCARGKV AGMPEAFEIWGQGTLVTVSSASTKGPSVFPLAPSS KSTSGGTAALGCLVKDYFPEPVTVSWNSGALTSG VHTFPAVLQSSGLYSLSSVVTVPSSSLGTQTYICNV NHKPSNTKVDKKVEPKSCDKTHTCPPCPAPELLG GPSVFLFPPKPKDTLMISRTPEVTCVVVDVSHEDPE VKFNWYVDGVEVHNAKTKPCEEQYGSTYRCVSV LTVLHQDWLNGKEYKCKVSNKALPAPIEKTISKA KGQPREPQVYTLPPSREEMTKNQVSLTCLVKGFYP SDIAVEWESNGQPENNYKTTPPVLDSDGSFFLYSK LTVDKSRWQQGNVFSCSVMHEALHNHYTQKSLS LSPGK SEQ ID NO: 628 |

In one embodiment the antibody or fragment thereof comprises a light chain variable region comprising a sequence selected from the group consisting of SEQ ID NOs: 1-157 and a heavy chain variable region comprising a sequence selected from the group consisting of SEQ ID NOs: 158-314.

In one embodiment the antibody or fragment thereof comprises a combination of light chain variable region and a heavy chain variable region selected from the group consisting of a light chain variable region comprising SEQ ID NO: 1 and a heavy chain variable region comprising SEQ ID NO: 158; a light chain variable region comprising SEQ ID NO: 2 and a heavy chain variable region comprising SEQ ID NO: 159; a light chain variable region comprising SEQ ID NO: 3 and a heavy chain variable region comprising SEQ ID NO: 160; a light chain variable region comprising SEQ ID NO: 4 and a heavy chain variable region comprising SEQ ID NO: 161; a light chain variable region comprising SEQ ID NO: 5 and a heavy chain variable region comprising SEQ ID NO: 162; a light chain variable region comprising SEQ ID NO: 6 and a heavy chain variable region comprising SEQ ID NO: 163; a light chain variable region comprising SEQ ID NO: 7 and a heavy chain variable region comprising SEQ ID NO: 164; a light chain variable region comprising SEQ ID NO: 8 and a heavy chain variable region comprising SEQ ID NO: 165; a light chain variable region comprising SEQ ID NO: 9 and a heavy chain variable region comprising SEQ ID NO: 166; a light chain variable region comprising SEQ ID NO: 10 and a heavy chain variable region comprising SEQ ID NO: 167; a light chain variable region comprising SEQ ID NO: 11 and a heavy chain variable region comprising SEQ ID NO: 168; a light chain variable region comprising SEQ ID NO: 12 and a heavy chain variable region comprising SEQ ID NO: 169; a light chain variable region comprising SEQ ID NO: 13 and a heavy chain variable region comprising SEQ ID NO: 170; a light chain variable region comprising SEQ ID NO: 14 and a heavy chain variable region comprising SEQ ID NO: 171; a light chain variable region comprising SEQ ID NO: 15 and a heavy chain variable region comprising SEQ ID NO: 172; a light chain variable region comprising SEQ ID NO: 16 and a heavy chain variable region comprising SEQ ID NO: 173; a light chain variable region comprising SEQ ID NO: 17 and a heavy chain variable region comprising SEQ ID NO: 174; a light chain variable region comprising SEQ ID NO: 18 and a heavy chain variable region comprising SEQ ID NO: 175; a light chain variable region comprising SEQ ID NO: 19 and a heavy chain variable region comprising SEQ ID NO: 176; a light chain variable region comprising SEQ ID NO: 20 and a heavy chain variable region comprising SEQ ID NO: 177; a light chain variable region comprising SEQ ID NO: 21 and a heavy chain variable region comprising SEQ ID NO: 178; a light chain variable region comprising SEQ ID NO: 22 and a heavy chain variable region comprising SEQ ID NO: 179; a light chain variable region comprising SEQ ID NO: 23 and a heavy chain variable region comprising SEQ ID NO: 180; a light chain variable region comprising SEQ ID NO: 24 and a heavy chain variable region comprising SEQ ID NO: 181; a light chain variable region comprising SEQ ID NO: 25 and a heavy chain variable region comprising SEQ ID NO: 182; a light chain variable region comprising SEQ ID NO: 26 and a heavy chain variable region comprising SEQ ID NO: 183; a light chain variable region comprising SEQ ID NO: 27 and a heavy chain variable region comprising SEQ ID NO: 184; a light chain variable region comprising SEQ ID NO: 28 and a heavy chain variable region comprising SEQ ID NO: 185; a light chain variable region comprising SEQ ID NO: 29 and a heavy chain variable region comprising SEQ ID NO: 186;

a light chain variable region comprising SEQ ID NO: 30 and a heavy chain variable region comprising SEQ ID NO: 187; a light chain variable region comprising SEQ ID NO: 31 and a heavy chain variable region comprising SEQ ID NO: 188; a light chain variable region comprising SEQ ID NO: 32 and a heavy chain variable region comprising SEQ ID NO: 189; a light chain variable region comprising SEQ ID NO: 33 and a heavy chain variable region comprising SEQ ID NO: 190; a light chain variable region comprising SEQ ID NO: 34 and a heavy chain variable region comprising SEQ ID NO: 191; a light chain variable region comprising SEQ ID NO: 35 and a heavy chain variable region comprising SEQ ID NO: 192; a light chain variable region comprising SEQ ID NO: 36 and a heavy chain variable region comprising SEQ ID NO: 193; a light chain variable region comprising SEQ ID NO: 37 and a heavy chain variable region comprising SEQ ID NO: 194; a light chain variable region comprising SEQ ID NO: 38 and a heavy chain variable region comprising SEQ ID NO: 195; a light chain variable region comprising SEQ ID NO: 39 and a heavy chain variable region comprising SEQ ID NO: 196; a light chain variable region comprising SEQ ID NO: 40 and a heavy chain variable region comprising SEQ ID NO: 197; a light chain variable region comprising SEQ ID NO: 41 and a heavy chain variable region comprising SEQ ID NO: 198; a light chain variable region comprising SEQ ID NO: 42 and a heavy chain variable region comprising SEQ ID NO: 199; a light chain variable region comprising SEQ ID NO: 43 and a heavy chain variable region comprising SEQ ID NO: 200; a light chain variable region comprising SEQ ID NO: 44 and a heavy chain variable region comprising SEQ ID NO: 201; a light chain variable region comprising SEQ ID NO: 45 and a heavy chain variable region comprising SEQ ID NO: 202; a light chain variable region comprising SEQ ID NO: 46 and a heavy chain variable region comprising SEQ ID NO: 203; a light chain variable region comprising SEQ ID NO: 47 and a heavy chain variable region comprising SEQ ID NO: 204; a light chain variable region comprising SEQ ID NO: 48 and a heavy chain variable region comprising SEQ ID NO: 205; a light chain variable region comprising SEQ ID NO: 49 and a heavy chain variable region comprising SEQ ID NO: 206; a light chain variable region comprising SEQ ID NO: 50 and a heavy chain variable region comprising SEQ ID NO: 207; a light chain variable region comprising SEQ ID NO: 51 and a heavy chain variable region comprising SEQ ID NO: 208; a light chain variable region comprising SEQ ID NO: 52 and a heavy chain variable region comprising SEQ ID NO: 209; a light chain variable region comprising SEQ ID NO: 53 and a heavy chain variable region comprising SEQ ID NO: 210; a light chain variable region comprising SEQ ID NO: 54 and a heavy chain variable region comprising SEQ ID NO: 211; a light chain variable region comprising SEQ ID NO: 55 and a heavy chain variable region comprising SEQ ID NO: 212; a light chain variable region comprising SEQ ID NO: 56 and a heavy chain variable region comprising SEQ ID NO: 213; a light chain variable region comprising SEQ ID NO: 57 and a heavy chain variable region comprising SEQ ID NO: 214; a light chain variable region comprising SEQ ID NO: 58 and a heavy chain variable region comprising SEQ ID NO: 215; a light chain variable region comprising SEQ ID NO: 59 and a heavy chain variable region comprising SEQ ID NO: 216; a light chain variable region comprising SEQ ID NO: 60 and a heavy chain variable region comprising SEQ ID NO: 217; a light chain variable region comprising SEQ ID NO: 61 and a heavy chain variable region comprising SEQ ID NO: 218; a light chain variable region comprising SEQ ID NO: 62 and a heavy chain variable region comprising SEQ ID NO: 219; a light chain variable region comprising SEQ ID NO: 63 and a heavy chain variable region comprising SEQ ID NO: 220; a light chain variable region comprising SEQ ID NO: 64 and a heavy chain variable region comprising SEQ ID NO: 221; a light chain variable region comprising SEQ ID NO: 65 and a heavy chain variable region comprising SEQ ID NO: 222; a light chain variable region comprising SEQ ID NO: 66 and a heavy chain variable region comprising SEQ ID NO: 223; a light chain variable region comprising SEQ ID NO: 67 and a heavy chain variable region comprising SEQ ID NO: 224; a light chain variable region comprising SEQ ID NO: 68 and a heavy chain variable region comprising SEQ ID NO: 225; a light chain variable region comprising SEQ ID NO: 69 and a heavy chain variable region comprising SEQ ID NO: 226; a light chain variable region comprising SEQ ID NO: 70 and a heavy chain variable region comprising SEQ ID NO: 227; a light chain variable region comprising SEQ ID NO: 71 and a heavy chain variable region comprising SEQ ID NO: 228; a light chain variable region comprising SEQ ID NO: 72 and a heavy chain variable region comprising SEQ ID NO: 229; a light chain variable region comprising SEQ ID NO: 73 and a heavy chain variable region comprising SEQ ID NO: 230; a light chain variable region comprising SEQ ID NO: 74 and a heavy chain variable region comprising SEQ ID NO: 231; a light chain variable region comprising SEQ ID NO: 75 and a heavy chain variable region comprising SEQ ID NO: 232; a light chain variable region comprising SEQ ID NO: 76 and a heavy chain variable region comprising SEQ ID NO: 233; a light chain variable region comprising SEQ ID NO: 77 and a heavy chain variable region comprising SEQ ID NO: 234; a light chain variable region comprising SEQ ID NO: 78 and a heavy chain variable region comprising SEQ ID NO: 235; a light chain variable region comprising SEQ ID NO: 79 and a heavy chain variable region comprising SEQ ID NO: 236; a light chain variable region comprising SEQ ID NO: 80 and a heavy chain variable region comprising SEQ ID NO: 237; a light chain variable region comprising SEQ ID NO: 81 and a heavy chain variable region comprising SEQ ID NO: 238; a light chain variable region comprising SEQ ID NO: 82 and a heavy chain variable region comprising SEQ ID NO: 239; a light chain variable region comprising SEQ ID NO: 83 and a heavy chain variable region comprising SEQ ID NO: 240; a light chain variable region comprising SEQ ID NO: 84 and a heavy chain variable region comprising SEQ ID NO: 241; a light chain variable region comprising SEQ ID NO: 85 and a heavy chain variable region comprising SEQ ID NO: 242; a light chain variable region comprising SEQ ID NO: 86 and a heavy chain variable region comprising SEQ ID NO: 243; a light chain variable region comprising SEQ ID NO: 87 and a heavy chain variable region comprising SEQ ID NO: 244; a light chain variable region comprising SEQ ID NO: 88 and a heavy chain variable region comprising SEQ ID NO: 245; a light chain variable region comprising SEQ ID NO: 89 and a heavy chain variable region comprising SEQ ID NO: 246; a light chain variable region comprising SEQ ID NO: 90 and a heavy chain variable region comprising SEQ ID NO: 247; a light chain variable region comprising SEQ ID NO: 91 and a heavy chain variable region comprising SEQ ID NO: 248; a light chain variable region comprising SEQ ID NO: 92 and a heavy chain variable region comprising SEQ ID NO: 249; a light chain variable region comprising SEQ ID NO: 93 and a heavy chain variable region comprising SEQ ID NO: 250; a light chain variable region comprising SEQ ID NO: 94 and a heavy chain variable region comprising SEQ ID NO: 251; a light chain variable region comprising SEQ ID NO: 95 and a heavy chain variable region comprising SEQ ID NO: 252; a light chain variable region comprising SEQ ID NO: 96 and a heavy chain variable region comprising SEQ ID NO: 253;

a light chain variable region comprising SEQ ID NO: 97 and a heavy chain variable region comprising SEQ ID NO: 254; a light chain variable region comprising SEQ ID NO: 98 and a heavy chain variable region comprising SEQ ID NO: 255; a light chain variable region comprising SEQ ID NO: 99 and a heavy chain variable region comprising SEQ ID NO: 256; a light chain variable region comprising SEQ ID NO: 100 and a heavy chain variable region comprising SEQ ID NO: 257; a light chain variable region comprising SEQ ID NO: 101 and a heavy chain variable region comprising SEQ ID NO: 258; a light chain variable region comprising SEQ ID NO: 102 and a heavy chain variable region comprising SEQ ID NO: 259; a light chain variable region comprising SEQ ID NO: 103 and a heavy chain variable region comprising SEQ ID NO: 260; a light chain variable region comprising SEQ ID NO: 104 and a heavy chain variable region comprising SEQ ID NO: 261; a light chain variable region comprising SEQ ID NO: 105 and a heavy chain variable region comprising SEQ ID NO: 262; a light chain variable region comprising SEQ ID NO: 106 and a heavy chain variable region comprising SEQ ID NO: 263; a light chain variable region comprising SEQ ID NO: 107 and a heavy chain variable region comprising SEQ ID NO: 264; a light chain variable region comprising SEQ ID NO: 108 and a heavy chain variable region comprising SEQ ID NO: 265; a light chain variable region comprising SEQ ID NO: 109 and a heavy chain variable region comprising SEQ ID NO: 266; a light chain variable region comprising SEQ ID NO: 110 and a heavy chain variable region comprising SEQ ID NO: 267; a light chain variable region comprising SEQ ID NO: 111 and a heavy chain variable region comprising SEQ ID NO: 268; a light chain variable region comprising SEQ ID NO: 112 and a heavy chain variable region comprising SEQ ID NO: 269; a light chain variable region comprising SEQ ID NO: 113 and a heavy chain variable region comprising SEQ ID NO: 270; a light chain variable region comprising SEQ ID NO: 114 and a heavy chain variable region comprising SEQ ID NO: 271; a light chain variable region comprising SEQ ID NO: 115 and a heavy chain variable region comprising SEQ ID NO: 272; a light chain variable region comprising SEQ ID NO: 116 and a heavy chain variable region comprising SEQ ID NO: 273; a light chain variable region comprising SEQ ID NO: 117 and a heavy chain variable region comprising SEQ ID NO: 274; a light chain variable region comprising SEQ ID NO: 118 and a heavy chain variable region comprising SEQ ID NO: 275; a light chain variable region comprising SEQ ID NO: 119 and a heavy chain variable region comprising SEQ ID NO: 276; a light chain variable region comprising SEQ ID NO: 120 and a heavy chain variable region comprising SEQ ID NO: 277; a light chain variable region comprising SEQ ID NO: 121 and a heavy chain variable region comprising SEQ ID NO: 278; a light chain variable region comprising SEQ ID NO: 122 and a heavy chain variable region comprising SEQ ID NO: 279; a light chain variable region comprising SEQ ID NO: 123 and a heavy chain variable region comprising SEQ ID NO: 280; a light chain variable region comprising SEQ ID NO: 124 and a heavy chain variable region comprising SEQ ID NO: 281; a light chain variable region comprising SEQ ID NO: 125 and a heavy chain variable region comprising SEQ ID NO: 282; a light chain variable region comprising SEQ ID NO: 126 and a heavy chain variable region comprising SEQ ID NO: 283; a light chain variable region comprising SEQ ID NO: 127 and a heavy chain variable region comprising SEQ ID NO: 284; a light chain variable region comprising SEQ ID NO: 128 and a heavy chain variable region comprising SEQ ID NO: 285; a light chain variable region comprising SEQ ID NO: 129 and a heavy chain variable region comprising SEQ ID NO: 286; a light chain variable region comprising SEQ ID NO: 130 and a heavy chain variable region comprising SEQ ID NO: 287; a light chain variable region comprising SEQ ID NO: 131 and a heavy chain variable region comprising SEQ ID NO: 288; a light chain variable region comprising SEQ ID NO: 132 and a heavy chain variable region comprising SEQ ID NO: 289; a light chain variable region comprising SEQ ID NO: 133 and a heavy chain variable region comprising SEQ ID NO: 290; a light chain variable region comprising SEQ ID NO: 134 and a heavy chain variable region comprising SEQ ID NO: 291; a light chain variable region comprising SEQ ID NO: 135 and a heavy chain variable region comprising SEQ ID NO: 292; a light chain variable region comprising SEQ ID NO: 136 and a heavy chain variable region comprising SEQ ID NO: 293; a light chain variable region comprising SEQ ID NO: 137 and a heavy chain variable region comprising SEQ ID NO: 294; a light chain variable region comprising SEQ ID NO: 138 and a heavy chain variable region comprising SEQ ID NO: 295; a light chain variable region comprising SEQ ID NO: 139 and a heavy chain variable region comprising SEQ ID NO: 296; a light chain variable region comprising SEQ ID NO: 140 and a heavy chain variable region comprising SEQ ID NO: 297; a light chain variable region comprising SEQ ID NO: 141 and a heavy chain variable region comprising SEQ ID NO: 298; a light chain variable region comprising SEQ ID NO: 142 and a heavy chain variable region comprising SEQ ID NO: 299; a light chain variable region comprising SEQ ID NO: 143 and a heavy chain variable region comprising SEQ ID NO: 300; a light chain variable region comprising SEQ ID NO: 144 and a heavy chain variable region comprising SEQ ID NO: 301; a light chain variable region comprising SEQ ID NO: 145 and a heavy chain variable region comprising SEQ ID NO: 302; a light chain variable region comprising SEQ ID NO: 146 and a heavy chain variable region comprising SEQ ID NO: 303; a light chain variable region comprising SEQ ID NO: 147 and a heavy chain variable region comprising SEQ ID NO: 304; a light chain variable region comprising SEQ ID NO: 148 and a heavy chain variable region comprising SEQ ID NO: 305; a light chain variable region comprising SEQ ID NO: 149 and a heavy chain variable region comprising SEQ ID NO: 306; a light chain variable region comprising SEQ ID NO: 150 and a heavy chain variable region comprising SEQ ID NO: 307; a light chain variable region comprising SEQ ID NO: 151 and a heavy chain variable region comprising SEQ ID NO: 308; a light chain variable region comprising SEQ ID NO: 152 and a heavy chain variable region comprising SEQ ID NO: 309; a light chain variable region comprising SEQ ID NO: 153 and a heavy chain variable region comprising SEQ ID NO: 310; a light chain variable region comprising SEQ ID NO: 154 and a heavy chain variable region comprising SEQ ID NO: 311; a light chain variable region comprising SEQ ID NO: 155 and a heavy chain variable region comprising SEQ ID NO: 312; a light chain variable region comprising SEQ ID NO: 156 and a heavy chain variable region comprising SEQ ID NO: 313; and a light chain variable region comprising SEQ ID NO: 157 and a heavy chain variable region comprising SEQ ID NO: 314.

In one embodiment the antibody or fragment thereof comprises a light chain variable region encoded by a polynucleotide sequence selected from the group consisting of SEQ ID NOs: 1571-1727 and a heavy chain variable region encoded by a polynucleotide sequence selected from the group consisting of SEQ ID NOs: 1728-1884.

In one embodiment the antibody or fragment thereof comprises a combination of light chain variable region and a heavy chain variable region selected from the group consisting of a light chain variable region encoded by a polynucleotide sequence comprising SEQ ID NO: 1571 and a heavy chain variable region encoded by a polynucleotide sequence comprising SEQ ID NO: 1728; a light chain variable region encoded by a polynucleotide sequence comprising SEQ ID NO: 1572 and a heavy chain variable region encoded by a polynucleotide sequence comprising SEQ ID NO: 1729; a light chain variable region encoded by a polynucleotide sequence comprising SEQ ID NO: 1573 and a heavy chain variable region encoded by a polynucleotide sequence comprising SEQ ID NO: 1730; a light chain variable region encoded by a polynucleotide sequence comprising SEQ ID NO: 1574 and a heavy chain variable region encoded by a polynucleotide sequence comprising SEQ ID NO: 1731; a light chain variable region encoded by a polynucleotide sequence comprising SEQ ID NO: 1575 and a heavy chain variable region encoded by a polynucleotide sequence comprising SEQ ID NO: 1732; a light chain variable region encoded by a polynucleotide sequence comprising SEQ ID NO: 1576 and a heavy chain variable region encoded by a polynucleotide sequence comprising SEQ ID NO: 1733; a light chain variable region encoded by a polynucleotide sequence comprising SEQ ID NO: 1577 and a heavy chain variable region encoded by a polynucleotide sequence comprising SEQ ID NO: 1734; a light chain variable region encoded by a polynucleotide sequence comprising SEQ ID NO: 1578 and a heavy chain variable region encoded by a polynucleotide sequence comprising SEQ ID NO: 1735; a light chain variable region encoded by a polynucleotide sequence comprising SEQ ID NO: 1579 and a heavy chain variable region encoded by a polynucleotide sequence comprising SEQ ID NO: 1736; a light chain variable region encoded by a polynucleotide sequence comprising SEQ ID NO: 1580 and a heavy chain variable region encoded by a polynucleotide sequence comprising SEQ ID NO: 1737; a light chain variable region encoded by a polynucleotide sequence comprising SEQ ID NO: 1581 and a heavy chain variable region encoded by a polynucleotide sequence comprising SEQ ID NO: 1738; a light chain variable region encoded by a polynucleotide sequence comprising SEQ ID NO: 1582 and a heavy chain variable region encoded by a polynucleotide sequence comprising SEQ ID NO: 1739; a light chain variable region encoded by a polynucleotide sequence comprising SEQ ID NO: 1583 and a heavy chain variable region encoded by a polynucleotide sequence comprising SEQ ID NO: 1740; a light chain variable region encoded by a polynucleotide sequence comprising SEQ ID NO: 1584 and a heavy chain variable region encoded by a polynucleotide sequence comprising SEQ ID NO: 1741; a light chain variable region encoded by a polynucleotide sequence comprising SEQ ID NO: 1585 and a heavy chain variable region encoded by a polynucleotide sequence comprising SEQ ID NO: 1742; a light chain variable region encoded by a polynucleotide sequence comprising SEQ ID NO: 1586 and a heavy chain variable region encoded by a polynucleotide sequence comprising SEQ ID NO: 1743; a light chain variable region encoded by a polynucleotide sequence comprising SEQ ID NO: 1587 and a heavy chain variable region encoded by a polynucleotide sequence comprising SEQ ID NO: 1744; a light chain variable region encoded by a polynucleotide sequence comprising SEQ ID NO: 1588 and a heavy chain variable region encoded by a polynucleotide sequence comprising SEQ ID NO: 1745; a light chain variable region encoded by a polynucleotide sequence comprising SEQ ID NO: 1589 and a heavy chain variable region encoded by a polynucleotide sequence comprising SEQ ID NO: 1746; a light chain variable region encoded by a polynucleotide sequence comprising SEQ ID NO: 1590 and a heavy chain variable region encoded by a polynucleotide sequence comprising SEQ ID NO: 1747; a light chain variable region encoded by a polynucleotide sequence comprising SEQ ID NO: 1591 and a heavy chain variable region encoded by a polynucleotide sequence comprising SEQ ID NO: 1748; a light chain variable region encoded by a polynucleotide sequence comprising SEQ ID NO: 1592 and a heavy chain variable region encoded by a polynucleotide sequence comprising SEQ ID NO: 1749; a light chain variable region encoded by a polynucleotide sequence comprising SEQ ID NO: 1593 and a heavy chain variable region encoded by a polynucleotide sequence comprising SEQ ID NO: 1750; a light chain variable region encoded by a polynucleotide sequence comprising SEQ ID NO: 1594 and a heavy chain variable region encoded by a polynucleotide sequence comprising SEQ ID NO: 1751; a light chain variable region encoded by a polynucleotide sequence comprising SEQ ID NO: 1595 and a heavy chain variable region encoded by a polynucleotide sequence comprising SEQ ID NO: 1752; a light chain variable region encoded by a polynucleotide sequence comprising SEQ ID NO: 1596 and a heavy chain variable region encoded by a polynucleotide sequence comprising SEQ ID NO: 1753; a light chain variable region encoded by a polynucleotide sequence comprising SEQ ID NO: 1597 and a heavy chain variable region encoded by a polynucleotide sequence comprising SEQ ID NO: 1754; a light chain variable region encoded by a polynucleotide sequence comprising SEQ ID NO: 1598 and a heavy chain variable region encoded by a polynucleotide sequence comprising SEQ ID NO: 1755; a light chain variable region encoded by a polynucleotide sequence comprising SEQ ID NO: 1599 and a heavy chain variable region encoded by a polynucleotide sequence comprising SEQ ID NO: 1756; a light chain variable region encoded by a polynucleotide sequence comprising SEQ ID NO: 1600 and a heavy chain variable region encoded by a polynucleotide sequence comprising SEQ ID NO: 1757; a light chain variable region encoded by a polynucleotide sequence comprising SEQ ID NO: 1601 and a heavy chain variable region encoded by a polynucleotide sequence comprising SEQ ID NO: 1758; a light chain variable region encoded by a polynucleotide sequence comprising SEQ ID NO: 1602 and a heavy chain variable region encoded by a polynucleotide sequence comprising SEQ ID NO: 1759; a light chain variable region encoded by a polynucleotide sequence comprising SEQ ID NO: 1603 and a heavy chain variable region encoded by a polynucleotide sequence comprising SEQ ID NO: 1760; a light chain variable region encoded by a polynucleotide sequence comprising SEQ ID NO: 1604 and a heavy chain variable region encoded by a polynucleotide sequence comprising SEQ ID NO: 1761; a light chain variable region encoded by a polynucleotide sequence comprising SEQ ID NO: 1605 and a heavy chain variable region encoded by a polynucleotide sequence comprising SEQ ID NO: 1762; a light chain variable region encoded by a polynucleotide sequence comprising SEQ ID NO: 1606 and a heavy chain variable region encoded by a polynucleotide sequence comprising SEQ ID NO: 1763; a light chain variable region encoded by a polynucleotide sequence comprising SEQ ID NO: 1607 and a heavy chain variable region encoded by a polynucleotide sequence comprising SEQ ID NO: 1764; a light chain variable region encoded by a polynucleotide sequence comprising SEQ ID NO: 1608 and a heavy chain variable region encoded by a polynucleotide sequence comprising SEQ ID NO: 1765; a light chain variable region encoded by a polynucleotide sequence comprising SEQ ID NO: 1609 and a heavy chain variable region encoded by a polynucleotide sequence comprising SEQ ID NO: 1766; a light chain variable region encoded by a polynucleotide sequence comprising SEQ ID NO: 1610 and a heavy chain variable region encoded by a polynucleotide sequence comprising SEQ ID NO: 1767; a light chain variable region encoded by a polynucleotide sequence comprising SEQ ID NO: 1611 and a heavy chain variable region encoded by a polynucleotide sequence comprising SEQ ID NO: 1768; a light chain variable region encoded by a polynucleotide sequence comprising SEQ ID NO: 1612 and a heavy chain variable region encoded by a polynucleotide sequence comprising SEQ ID NO: 1769; a light chain variable region encoded by a polynucleotide sequence comprising SEQ ID NO: 1613 and a heavy chain variable region encoded by a polynucleotide sequence comprising SEQ ID NO: 1770; a light chain variable region encoded by a polynucleotide sequence comprising SEQ ID NO: 1614 and a heavy chain variable region encoded by a polynucleotide sequence comprising SEQ ID NO: 1771; a light chain variable region encoded by a polynucleotide sequence comprising SEQ ID NO: 1615 and a heavy chain variable region encoded by a polynucleotide sequence comprising SEQ ID NO: 1772; a light chain variable region encoded by a polynucleotide sequence comprising SEQ ID NO: 1616 and a heavy chain variable region encoded by a polynucleotide sequence comprising SEQ ID NO: 1773; a light chain variable region encoded by a polynucleotide sequence comprising SEQ ID NO: 1617 and a heavy chain variable region encoded by a polynucleotide sequence comprising SEQ ID NO: 1774; a light chain variable region encoded by a polynucleotide sequence comprising SEQ ID NO: 1618 and a heavy chain variable region encoded by a polynucleotide sequence comprising SEQ ID NO: 1775; a light chain variable region encoded by a polynucleotide sequence comprising SEQ ID NO: 1619 and a heavy chain variable region encoded by a polynucleotide sequence comprising SEQ ID NO: 1776; a light chain variable region encoded by a polynucleotide sequence comprising SEQ ID NO: 1620 and a heavy chain variable region encoded by a polynucleotide sequence comprising SEQ ID NO: 1777; a light chain variable region encoded by a polynucleotide sequence comprising SEQ ID NO: 1621 and a heavy chain variable region encoded by a polynucleotide sequence comprising SEQ ID NO: 1778; a light chain variable region encoded by a polynucleotide sequence comprising SEQ ID NO: 1622 and a heavy chain variable region encoded by a polynucleotide sequence comprising SEQ ID NO: 1779; a light chain variable region encoded by a polynucleotide sequence comprising SEQ ID NO: 1623 and a heavy chain variable region encoded by a polynucleotide sequence comprising SEQ ID NO: 1780; a light chain variable region encoded by a polynucleotide sequence comprising SEQ ID NO: 1624 and a heavy chain variable region encoded by a polynucleotide sequence comprising SEQ ID NO: 1781; a light chain variable region encoded by a polynucleotide sequence comprising SEQ ID NO: 1625 and a heavy chain variable region encoded by a polynucleotide sequence comprising SEQ ID NO: 1782; a light chain variable region encoded by a polynucleotide sequence comprising SEQ ID NO: 1626 and a heavy chain variable region encoded by a polynucleotide sequence comprising SEQ ID NO: 1783; a light chain variable region encoded by a polynucleotide sequence comprising SEQ ID NO: 1627 and a heavy chain variable region encoded by a polynucleotide sequence comprising SEQ ID NO: 1784; a light chain variable region encoded by a polynucleotide sequence comprising SEQ ID NO: 1628 and a heavy chain variable region encoded by a polynucleotide sequence comprising SEQ ID NO: 1785; a light chain variable region encoded by a polynucleotide sequence comprising SEQ ID NO: 1629 and a heavy chain variable region encoded by a polynucleotide sequence comprising SEQ ID NO: 1786; a light chain variable region encoded by a polynucleotide sequence comprising SEQ ID NO: 1630 and a heavy chain variable region encoded by a polynucleotide sequence comprising SEQ ID NO: 1787; a light chain variable region encoded by a polynucleotide sequence comprising SEQ ID NO: 1631 and a heavy chain variable region encoded by a polynucleotide sequence comprising SEQ ID NO: 1788; a light chain variable region encoded by a polynucleotide sequence comprising SEQ ID NO: 1632 and a heavy chain variable region encoded by a polynucleotide sequence comprising SEQ ID NO: 1789; a light chain variable region encoded by a polynucleotide sequence comprising SEQ ID NO: 1633 and a heavy chain variable region encoded by a polynucleotide sequence comprising SEQ ID NO: 1790; a light chain variable region encoded by a polynucleotide sequence comprising SEQ ID NO: 1634 and a heavy chain variable region encoded by a polynucleotide sequence comprising SEQ ID NO: 1791; a light chain variable region encoded by a polynucleotide sequence comprising SEQ ID NO: 1635 and a heavy chain variable region encoded by a polynucleotide sequence comprising SEQ ID NO: 1792; a light chain variable region encoded by a polynucleotide sequence comprising SEQ ID NO: 1636 and a heavy chain variable region encoded by a polynucleotide sequence comprising SEQ ID NO: 1793; a light chain variable region encoded by a polynucleotide sequence comprising SEQ ID NO: 1637 and a heavy chain variable region encoded by a polynucleotide sequence comprising SEQ ID NO: 1794; a light chain variable region encoded by a polynucleotide sequence comprising SEQ ID NO: 1638 and a heavy chain variable region encoded by a polynucleotide sequence comprising SEQ ID NO: 1795; a light chain variable region encoded by a polynucleotide sequence comprising SEQ ID NO: 1639 and a heavy chain variable region encoded by a polynucleotide sequence comprising SEQ ID NO: 1796; a light chain variable region encoded by a polynucleotide sequence comprising SEQ ID NO: 1640 and a heavy chain variable region encoded by a polynucleotide sequence comprising SEQ ID NO: 1797; a light chain variable region encoded by a polynucleotide sequence comprising SEQ ID NO: 1641 and a heavy chain variable region encoded by a polynucleotide sequence comprising SEQ ID NO: 1798; a light chain variable region encoded by a polynucleotide sequence comprising SEQ ID NO: 1642 and a heavy chain variable region encoded by a polynucleotide sequence comprising SEQ ID NO: 1799; a light chain variable region encoded by a polynucleotide sequence comprising SEQ ID NO: 1643 and a heavy chain variable region encoded by a polynucleotide sequence comprising SEQ ID NO: 1800; a light chain variable region encoded by a polynucleotide sequence comprising SEQ ID NO: 1644 and a heavy chain variable region encoded by a polynucleotide sequence comprising SEQ ID NO: 1801; a light chain variable region encoded by a polynucleotide sequence comprising SEQ ID NO: 1645 and a heavy chain variable region encoded by a polynucleotide sequence comprising SEQ ID NO: 1802; a light chain variable region encoded by a polynucleotide sequence comprising SEQ ID NO: 1646 and a heavy chain variable region encoded by a polynucleotide sequence comprising SEQ ID NO: 1803; a light chain variable region encoded by a polynucleotide sequence comprising SEQ ID NO: 1647 and a heavy chain variable region encoded by a polynucleotide sequence comprising SEQ ID NO: 1804; a light chain variable region encoded by a polynucleotide sequence comprising SEQ ID NO: 1648 and a heavy chain variable region encoded by a polynucleotide sequence comprising SEQ ID NO: 1805; a light chain variable region encoded by a polynucleotide sequence comprising SEQ ID NO: 1649 and a heavy chain variable region encoded by a polynucleotide sequence comprising SEQ ID NO: 1806; a light chain variable region encoded by a polynucleotide sequence comprising SEQ ID NO: 1650 and a heavy chain variable region encoded by a polynucleotide sequence comprising SEQ ID NO: 1807; a light chain variable region encoded by a polynucleotide sequence comprising SEQ ID NO: 1651 and a heavy chain variable region encoded by a polynucleotide sequence comprising SEQ ID NO: 1808; a light chain variable region encoded by a polynucleotide sequence comprising SEQ ID NO: 1652 and a heavy chain variable region encoded by a polynucleotide sequence comprising SEQ ID NO: 1809; a light chain variable region encoded by a polynucleotide sequence comprising SEQ ID NO: 1653 and a heavy chain variable region encoded by a polynucleotide sequence comprising SEQ ID NO: 1810; a light chain variable region encoded by a polynucleotide sequence comprising SEQ ID NO: 1654 and a heavy chain variable region encoded by a polynucleotide sequence comprising SEQ ID NO: 1811; a light chain variable region encoded by a polynucleotide sequence comprising SEQ ID NO: 1655 and a heavy chain variable region encoded by a polynucleotide sequence comprising SEQ ID NO: 1812; a light chain variable region encoded by a polynucleotide sequence comprising SEQ ID NO: 1656 and a heavy chain variable region encoded by a polynucleotide sequence comprising SEQ ID NO: 1813; a light chain variable region encoded by a polynucleotide sequence comprising SEQ ID NO: 1657 and a heavy chain variable region encoded by a polynucleotide sequence comprising SEQ ID NO: 1814; a light chain variable region encoded by a polynucleotide sequence comprising SEQ ID NO: 1658 and a heavy chain variable region encoded by a polynucleotide sequence comprising SEQ ID NO: 1815; a light chain variable region encoded by a polynucleotide sequence comprising SEQ ID NO: 1659 and a heavy chain variable region encoded by a polynucleotide sequence comprising SEQ ID NO: 1816; a light chain variable region encoded by a polynucleotide sequence comprising SEQ ID NO: 1660 and a heavy chain variable region encoded by a polynucleotide sequence comprising SEQ ID NO: 1817; a light chain variable region encoded by a polynucleotide sequence comprising SEQ ID NO: 1661 and a heavy chain variable region encoded by a polynucleotide sequence comprising SEQ ID NO: 1818; a light chain variable region encoded by a polynucleotide sequence comprising SEQ ID NO: 1662 and a heavy chain variable region encoded by a polynucleotide sequence comprising SEQ ID NO: 1819; a light chain variable region encoded by a polynucleotide sequence comprising SEQ ID NO: 1663 and a heavy chain variable region encoded by a polynucleotide sequence comprising SEQ ID NO: 1820; a light chain variable region encoded by a polynucleotide sequence comprising SEQ ID NO: 1664 and a heavy chain variable region encoded by a polynucleotide sequence comprising SEQ ID NO: 1821; a light chain variable region encoded by a polynucleotide sequence comprising SEQ ID NO: 1665 and a heavy chain variable region encoded by a polynucleotide sequence comprising SEQ ID NO: 1822; a light chain variable region encoded by a polynucleotide sequence comprising SEQ ID NO: 1666 and a heavy chain variable region encoded by a polynucleotide sequence comprising SEQ ID NO: 1823; a light chain variable region encoded by a polynucleotide sequence comprising SEQ ID NO: 1667 and a heavy chain variable region encoded by a polynucleotide sequence comprising SEQ ID NO: 1824; a light chain variable region encoded by a polynucleotide sequence comprising SEQ ID NO: 1668 and a heavy chain variable region encoded by a polynucleotide sequence comprising SEQ ID NO: 1825; a light chain variable region encoded by a polynucleotide sequence comprising SEQ ID NO: 1669 and a heavy chain variable region encoded by a polynucleotide sequence comprising SEQ ID NO: 1826; a light chain variable region encoded by a polynucleotide sequence comprising SEQ ID NO: 1670 and a heavy chain variable region encoded by a polynucleotide sequence comprising SEQ ID NO: 1827; a light chain variable region encoded by a polynucleotide sequence comprising SEQ ID NO: 1671 and a heavy chain variable region encoded by a polynucleotide sequence comprising SEQ ID NO: 1828; a light chain variable region encoded by a polynucleotide sequence comprising SEQ ID NO: 1672 and a heavy chain variable region encoded by a polynucleotide sequence comprising SEQ ID NO: 1829; a light chain variable region encoded by a polynucleotide sequence comprising SEQ ID NO: 1673 and a heavy chain variable region encoded by a polynucleotide sequence comprising SEQ ID NO: 1830; a light chain variable region encoded by a polynucleotide sequence comprising SEQ ID NO: 1674 and a heavy chain variable region encoded by a polynucleotide sequence comprising SEQ ID NO: 1831; a light chain variable region encoded by a polynucleotide sequence comprising SEQ ID NO: 1675 and a heavy chain variable region encoded by a polynucleotide sequence comprising SEQ ID NO: 1832; a light chain variable region encoded by a polynucleotide sequence comprising SEQ ID NO: 1676 and a heavy chain variable region encoded by a polynucleotide sequence comprising SEQ ID NO: 1833; a light chain variable region encoded by a polynucleotide sequence comprising SEQ ID NO: 1677 and a heavy chain variable region encoded by a polynucleotide sequence comprising SEQ ID NO: 1834; a light chain variable region encoded by a polynucleotide sequence comprising SEQ ID NO: 1678 and a heavy chain variable region encoded by a polynucleotide sequence comprising SEQ ID NO: 1835; a light chain variable region encoded by a polynucleotide sequence comprising SEQ ID NO: 1679 and a heavy chain variable region encoded by a polynucleotide sequence comprising SEQ ID NO: 1836; a light chain variable region encoded by a polynucleotide sequence comprising SEQ ID NO: 1680 and a heavy chain variable region encoded by a polynucleotide sequence comprising SEQ ID NO: 1837; a light chain variable region encoded by a polynucleotide sequence comprising SEQ ID NO: 1681 and a heavy chain variable region encoded by a polynucleotide sequence comprising SEQ ID NO: 1838; a light chain variable region encoded by a polynucleotide sequence comprising SEQ ID NO: 1682 and a heavy chain variable region encoded by a polynucleotide sequence comprising SEQ ID NO: 1839; a light chain variable region encoded by a polynucleotide sequence comprising SEQ ID NO: 1683 and a heavy chain variable region encoded by a polynucleotide sequence comprising SEQ ID NO: 1840; a light chain variable region encoded by a polynucleotide sequence comprising SEQ ID NO: 1684 and a heavy chain variable region encoded by a polynucleotide sequence comprising SEQ ID NO: 1841; a light chain variable region encoded by a polynucleotide sequence comprising SEQ ID NO: 1685 and a heavy chain variable region encoded by a polynucleotide sequence comprising SEQ ID NO: 1842; a light chain variable region encoded by a polynucleotide sequence comprising SEQ ID NO: 1686 and a heavy chain variable region encoded by a polynucleotide sequence comprising SEQ ID NO: 1843; a light chain variable region encoded by a polynucleotide sequence comprising SEQ ID NO: 1687 and a heavy chain variable region encoded by a polynucleotide sequence comprising SEQ ID NO: 1844; a light chain variable region encoded by a polynucleotide sequence comprising SEQ ID NO: 1688 and a heavy chain variable region encoded by a polynucleotide sequence comprising SEQ ID NO: 1845; a light chain variable region encoded by a polynucleotide sequence comprising SEQ ID NO: 1689 and a heavy chain variable region encoded by a polynucleotide sequence comprising SEQ ID NO: 1846; a light chain variable region encoded by a polynucleotide sequence comprising SEQ ID NO: 1690 and a heavy chain variable region encoded by a polynucleotide sequence comprising SEQ ID NO: 1847; a light chain variable region encoded by a polynucleotide sequence comprising SEQ ID NO: 1691 and a heavy chain variable region encoded by a polynucleotide sequence comprising SEQ ID NO: 1848; a light chain variable region encoded by a polynucleotide sequence comprising SEQ ID NO: 1692 and a heavy chain variable region encoded by a polynucleotide sequence comprising SEQ ID NO: 1849; a light chain variable region encoded by a polynucleotide sequence comprising SEQ ID NO: 1693 and a heavy chain variable region encoded by a polynucleotide sequence comprising SEQ ID NO: 1850; a light chain variable region encoded by a polynucleotide sequence comprising SEQ ID NO: 1694 and a heavy chain variable region encoded by a polynucleotide sequence comprising SEQ ID NO: 1851; a light chain variable region encoded by a polynucleotide sequence comprising SEQ ID NO: 1695 and a heavy chain variable region encoded by a polynucleotide sequence comprising SEQ ID NO: 1852; a light chain variable region encoded by a polynucleotide sequence comprising SEQ ID NO: 1696 and a heavy chain variable region encoded by a polynucleotide sequence comprising SEQ ID NO: 1853; a light chain variable region encoded by a polynucleotide sequence comprising SEQ ID NO: 1697 and a heavy chain variable region encoded by a polynucleotide sequence comprising SEQ ID NO: 1854; a light chain variable region encoded by a polynucleotide sequence comprising SEQ ID NO: 1698 and a heavy chain variable region encoded by a polynucleotide sequence comprising SEQ ID NO: 1855; a light chain variable region encoded by a polynucleotide sequence comprising SEQ ID NO: 1699 and a heavy chain variable region encoded by a polynucleotide sequence comprising SEQ ID NO: 1856; a light chain variable region encoded by a polynucleotide sequence comprising SEQ ID NO: 1700 and a heavy chain variable region encoded by a polynucleotide sequence comprising SEQ ID NO: 1857; a light chain variable region encoded by a polynucleotide sequence comprising SEQ ID NO: 1701 and a heavy chain variable region encoded by a polynucleotide sequence comprising SEQ ID NO: 1858; a light chain variable region encoded by a polynucleotide sequence comprising SEQ ID NO: 1702 and a heavy chain variable region encoded by a polynucleotide sequence comprising SEQ ID NO: 1859; a light chain variable region encoded by a polynucleotide sequence comprising SEQ ID NO: 1703 and a heavy chain variable region encoded by a polynucleotide sequence comprising SEQ ID NO: 1860; a light chain variable region encoded by a polynucleotide sequence comprising SEQ ID NO: 1704 and a heavy chain variable region encoded by a polynucleotide sequence comprising SEQ ID NO: 1861; a light chain variable region encoded by a polynucleotide sequence comprising SEQ ID NO: 1705 and a heavy chain variable region encoded by a polynucleotide sequence comprising SEQ ID NO: 1862; a light chain variable region encoded by a polynucleotide sequence comprising SEQ ID NO: 1706 and a heavy chain variable region encoded by a polynucleotide sequence comprising SEQ ID NO: 1863; a light chain variable region encoded by a polynucleotide sequence comprising SEQ ID NO: 1707 and a heavy chain variable region encoded by a polynucleotide sequence comprising SEQ ID NO: 1864; a light chain variable region encoded by a polynucleotide sequence comprising SEQ ID NO: 1708 and a heavy chain variable region encoded by a polynucleotide sequence comprising SEQ ID NO: 1865; a light chain variable region encoded by a polynucleotide sequence comprising SEQ ID NO: 1709 and a heavy chain variable region encoded by a polynucleotide sequence comprising SEQ ID NO: 1866; a light chain variable region encoded by a polynucleotide sequence comprising SEQ ID NO: 1710 and a heavy chain variable region encoded by a polynucleotide sequence comprising SEQ ID NO: 1867; a light chain variable region encoded by a polynucleotide sequence comprising SEQ ID NO: 1711 and a heavy chain variable region encoded by a polynucleotide sequence comprising SEQ ID NO: 1868; a light chain variable region encoded by a polynucleotide sequence comprising SEQ ID NO: 1712 and a heavy chain variable region encoded by a polynucleotide sequence comprising SEQ ID NO: 1869; a light chain variable region encoded by a polynucleotide sequence comprising SEQ ID NO: 1713 and a heavy chain variable region encoded by a polynucleotide sequence comprising SEQ ID NO: 1870; a light chain variable region encoded by a polynucleotide sequence comprising SEQ ID NO: 1714 and a heavy chain variable region encoded by a polynucleotide sequence comprising SEQ ID NO: 1871; a light chain variable region encoded by a polynucleotide sequence comprising SEQ ID NO: 1715 and a heavy chain variable region encoded by a polynucleotide sequence comprising SEQ ID NO: 1872; a light chain variable region encoded by a polynucleotide sequence comprising SEQ ID NO: 1716 and a heavy chain variable region encoded by a polynucleotide sequence comprising SEQ ID NO: 1873; a light chain variable region encoded by a polynucleotide sequence comprising SEQ ID NO: 1717 and a heavy chain variable region encoded by a polynucleotide sequence comprising SEQ ID NO: 1874; a light chain variable region encoded by a polynucleotide sequence comprising SEQ ID NO: 1718 and a heavy chain variable region encoded by a polynucleotide sequence comprising SEQ ID NO: 1875; a light chain variable region encoded by a polynucleotide sequence comprising SEQ ID NO: 1719 and a heavy chain variable region encoded by a polynucleotide sequence comprising SEQ ID NO: 1876; a light chain variable region encoded by a polynucleotide sequence comprising SEQ ID NO: 1720 and a heavy chain variable region encoded by a polynucleotide sequence comprising SEQ ID NO: 1877; a light chain variable region encoded by a polynucleotide sequence comprising SEQ ID NO: 1721 and a heavy chain variable region encoded by a polynucleotide sequence comprising SEQ ID NO: 1878; a light chain variable region encoded by a polynucleotide sequence comprising SEQ ID NO: 1722 and a heavy chain variable region encoded by a polynucleotide sequence comprising SEQ ID NO: 1879; a light chain variable region encoded by a polynucleotide sequence comprising SEQ ID NO: 1723 and a heavy chain variable region encoded by a polynucleotide sequence comprising SEQ ID NO: 1880; a light chain variable region encoded by a polynucleotide sequence comprising SEQ ID NO: 1724 and a heavy chain variable region encoded by a polynucleotide sequence comprising SEQ ID NO: 1881; a light chain variable region encoded by a polynucleotide sequence comprising SEQ ID NO: 1725 and a heavy chain variable region encoded by a polynucleotide sequence comprising SEQ ID NO: 1882; a light chain variable region encoded by a polynucleotide sequence comprising SEQ ID NO: 1726 and a heavy chain variable region encoded by a polynucleotide sequence comprising SEQ ID NO: 1883; and a light chain variable region encoded by a polynucleotide sequence comprising SEQ ID NO: 1727 and a heavy chain variable region encoded by a polynucleotide sequence comprising SEQ ID NO: 1884.

Some antigen binding proteins comprise a variable light domain and a variable heavy domain as listed in one of the rows for one of the antibodies listed in TABLE 3. In some instances, the antigen binding protein comprises two identical variable light domains and two identical variable heavy domains from one of the antibodies listed in TABLE 3. Some antigen binding proteins that are provided comprise a variable light domain and a variable heavy domain as listed in one of the rows for one of the antibodies listed in TABLE 3, except that one or both of the domains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the variable domain sequences specified in TABLE 3. In one embodiment, the antigen binding protein comprises a variable region sequence from Table 3, but with the N-terminal methionine deleted. Other antigen binding proteins also comprise a variable light domain and a variable heavy domain as listed in one of the rows for one of the antibodies listed in TABLE 3, except that one or both of the domains differs from the sequence specified in the table in that the heavy chain variable domain and/or light chain variable domain comprises or consists of a sequence of amino acids that has at least 70%, 75%, 80%, 85%, 90%, 95%, 96%, 97%, 98%, or 99% sequence identity to the amino acid sequences of the heavy chain variable domain or light chain variable domain sequences as specified in TABLE 3.

In another aspect, the antigen binding protein consists just of a variable light or variable heavy domain from an antibody listed in TABLE 3. In still another aspect, the antigen binding protein comprises two or more of the same variable heavy domains or two or more of the same variable light domains from those listed in TABLE 3. Such domain antibodies can be fused together or joined via a linker as described in greater detail below. The domain antibodies can also be fused or linked to one or more molecules to extend the half-life (e.g., PEG or albumin).

Other antigen binding proteins that are provided are variants of antibodies formed by combination of the heavy and light chains shown in TABLE 3 and comprise light and/or heavy chains that each have at least 70%, 75%, 80%, 85%, 90%, 95%, 96%, 97%, 98% or 99% identity to the amino acid sequences of these chains. In some instances, such antibodies include at least one heavy chain and one light chain, whereas in other instances the variant forms contain two identical light chains and two identical heavy chains.

The various combinations of heavy chain variable regions may be combined with any of the various combinations of light chain variable regions.

In a further embodiment, the isolated antigen binding protein provided herein is a human antibody comprising a sequence as set forth in TABLE 3 and is of the $IgG_1$-, $IgG_2$-$IgG_3$- or $IgG_4$-type.

The antigen binding proteins disclosed herein are polypeptides into which one or more CDRs are grafted, inserted and/or joined. An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3"). Some antigen binding proteins include both a CDRH3 and a CDRL3. Specific light and heavy chain CDRs are identified in TABLEs 4A and 4B, respectively.

Complementarity determining regions (CDRs) and framework regions (FR) of a given antibody may be identified using the system described by Kabat et al. in Sequences of Proteins of Immunological Interest, 5th Ed., US Dept. of Health and Human Services, PHS, NIH, NIH Publication no. 91-3242, 1991. Certain antibodies that are disclosed herein comprise one or more amino acid sequences that are identical or have substantial sequence identity to the amino acid sequences of one or more of the CDRs presented in TABLES 4A and 4B. These CDRs use the system described by Kabat et al. as noted above.

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, supra (Kabat et al., 1991, *Sequences of Proteins of Immunological Interest*, Public Health Service N.I.H., Bethesda, M D: see also Chothia and Lesk, 1987, *J. Mol. Biol.* 196:901-917: Chothia et al., 1989, *Nature* 342:877-883), within a framework region (designated framework regions 1-4, FR1, FR2, FR3, and FR4, by Kabat et al., 1991, supra; see also Chothia and Lesk, 1987, supra). The CDRs provided herein, however, may not only be used to define the antigen binding domain of a traditional antibody structure, but may be embedded in a variety of other polypeptide structures, as described herein.

In one embodiment the antibody or fragment thereof comprises a CDRL1, a CDRL2, a CDRL3, a CDRH1, a CDRH2, and a CDRH3. In one embodiment the antibody or fragment thereof comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, comprises a sequence selected from the group consisting of SEQ ID NO: 629, SEQ ID NO: 786, SEQ ID NO: 943, SEQ ID NO: 1100, SEQ ID NO: 1257, and SEQ ID NO: 1414; SEQ ID NO: 630, SEQ ID NO: 787, SEQ ID NO: 944, SEQ ID NO: 1101, SEQ ID NO: 1258, and SEQ ID NO: 1415; SEQ ID NO: 631, SEQ ID NO: 788, SEQ ID NO: 945, SEQ ID NO: 1102, SEQ ID NO: 1259, and SEQ ID NO: 1416; SEQ ID NO: 632, SEQ ID NO: 789, SEQ ID NO: 946, SEQ ID NO: 1103, SEQ ID NO: 1260, and SEQ ID NO: 1417; SEQ ID NO: 633, SEQ ID NO: 790, SEQ ID NO: 947, SEQ ID NO: 1104, SEQ ID NO: 1261, and SEQ ID NO: 1418; SEQ ID NO: 634, SEQ ID NO: 791, SEQ ID NO: 948, SEQ ID NO: 1105, SEQ ID NO: 1262, and SEQ ID NO: 1419; SEQ ID NO: 635, SEQ ID NO: 792, SEQ ID NO: 949, SEQ ID NO: 1106, SEQ ID NO: 1263, and SEQ ID NO: 1420; SEQ ID NO: 636, SEQ ID NO: 793, SEQ ID NO: 950, SEQ ID NO: 1107, SEQ ID NO: 1264, and SEQ ID NO: 1421; SEQ ID NO: 637, SEQ ID NO: 794, SEQ ID NO: 951, SEQ ID NO: 1108, SEQ ID NO: 1265, and SEQ ID NO: 1422; SEQ ID NO: 638, SEQ ID NO: 795, SEQ ID NO: 952, SEQ ID NO: 1109, SEQ ID NO: 1266, and SEQ ID NO: 1423; SEQ ID NO: 639, SEQ ID NO: 796, SEQ ID NO: 953, SEQ ID NO: 1110, SEQ ID NO: 1267, and SEQ ID NO: 1424; SEQ ID NO: 640, SEQ ID NO: 797, SEQ ID NO: 954, SEQ ID NO: 1111, SEQ ID NO: 1268, and SEQ ID NO: 1425; SEQ ID NO: 641, SEQ ID NO: 798, SEQ ID NO: 955, SEQ ID NO: 1112, SEQ ID NO: 1269, and SEQ ID NO: 1426; SEQ ID NO: 642, SEQ ID NO: 799, SEQ ID NO: 956, SEQ ID NO: 1113, SEQ ID NO: 1270, and SEQ ID NO: 1427; SEQ ID NO: 643, SEQ ID NO: 800, SEQ ID NO: 957, SEQ ID NO: 1114, SEQ ID NO: 1271, and SEQ ID NO: 1428; SEQ ID NO: 644, SEQ ID NO: 801, SEQ ID NO: 958, SEQ ID NO: 1115, SEQ ID NO: 1272, and SEQ ID NO: 1429; SEQ ID NO: 645, SEQ ID NO: 802, SEQ ID NO: 959, SEQ ID NO: 1116, SEQ ID NO: 1273, and SEQ ID NO: 1430; SEQ ID NO: 646, SEQ ID NO: 803, SEQ ID NO: 960, SEQ ID NO: 1117, SEQ ID NO: 1274, and SEQ ID NO: 1431; SEQ ID NO: 647, SEQ ID NO: 804, SEQ ID NO: 961, SEQ ID NO: 1118, SEQ ID NO: 1275, and SEQ ID NO: 1432; SEQ ID NO: 648, SEQ ID NO: 805, SEQ ID NO: 962, SEQ ID NO: 1119, SEQ ID NO: 1276, and SEQ ID NO: 1433; SEQ ID NO: 649, SEQ ID NO: 806, SEQ ID NO: 963, SEQ ID NO: 1120, SEQ ID NO: 1277, and SEQ ID NO: 1434; SEQ ID NO: 650, SEQ ID NO: 807, SEQ ID NO: 964, SEQ ID NO: 1121, SEQ ID NO: 1278, and SEQ ID NO: 1435; SEQ ID NO: 651, SEQ ID NO: 808, SEQ ID NO: 965, SEQ ID NO: 1122, SEQ ID NO: 1279, and SEQ ID NO: 1436; SEQ ID NO: 652, SEQ ID NO: 809, SEQ ID NO: 966, SEQ ID NO: 1123, SEQ ID NO: 1280, and SEQ ID NO: 1437; SEQ ID NO: 653, SEQ ID NO: 810, SEQ ID NO: 967, SEQ ID NO: 1124, SEQ ID NO: 1281, and SEQ ID NO: 1438; SEQ ID NO: 654, SEQ ID NO: 811, SEQ ID NO: 968, SEQ ID NO: 1125, SEQ ID NO: 1282, and SEQ ID NO: 1439; SEQ ID NO: 655, SEQ ID NO: 812, SEQ ID NO: 969, SEQ ID NO: 1126, SEQ ID NO: 1283, and SEQ ID NO: 1440; SEQ ID NO: 656, SEQ ID NO: 813, SEQ ID NO: 970, SEQ ID NO: 1127, SEQ ID NO: 1284, and SEQ ID NO: 1441; SEQ ID NO: 657, SEQ ID NO: 814, SEQ ID NO: 971, SEQ ID NO: 1128, SEQ ID NO: 1285, and SEQ ID NO: 1442; SEQ ID NO: 658, SEQ ID NO: 815, SEQ ID NO: 972, SEQ ID NO: 1129, SEQ ID NO: 1286, and SEQ ID NO: 1443; SEQ ID NO: 659, SEQ ID NO: 816, SEQ ID NO: 973, SEQ ID NO: 1130, SEQ ID NO: 1287, and SEQ ID NO: 1444; SEQ ID NO: 660, SEQ ID NO: 817, SEQ ID NO: 974, SEQ ID NO: 1131, SEQ ID NO: 1288, and SEQ ID NO: 1445; SEQ ID NO: 661, SEQ ID NO: 818, SEQ ID NO: 975, SEQ ID NO: 1132, SEQ ID NO: 1289, and SEQ ID NO: 1446; SEQ ID NO: 662, SEQ ID NO: 819, SEQ ID NO: 976, SEQ ID NO: 1133, SEQ ID NO: 1290, and SEQ ID NO: 1447; SEQ ID NO: 663, SEQ ID NO: 820, SEQ ID NO: 977, SEQ ID NO: 1134, SEQ ID NO: 1291, and SEQ ID NO: 1448; SEQ ID NO: 664, SEQ ID NO: 821, SEQ ID NO: 978, SEQ ID NO: 1135, SEQ ID NO: 1292, and SEQ ID NO: 1449; SEQ ID NO: 665, SEQ ID NO: 822, SEQ ID NO: 979, SEQ ID NO: 1136, SEQ ID NO: 1293, and SEQ ID NO: 1450; SEQ ID NO: 666, SEQ ID NO: 823, SEQ ID NO: 980, SEQ ID NO: 1137, SEQ ID NO: 1294, and SEQ ID NO: 1451; SEQ ID NO: 667, SEQ ID NO: 824, SEQ ID NO: 981, SEQ ID NO: 1138, SEQ ID NO: 1295, and SEQ ID NO: 1452; SEQ ID NO: 668, SEQ ID NO: 825, SEQ ID NO: 982, SEQ ID NO: 1139, SEQ ID NO: 1296, and SEQ ID NO: 1453; SEQ ID NO: 669, SEQ ID NO: 826, SEQ ID NO: 983, SEQ ID NO: 1140, SEQ ID NO: 1297, and SEQ ID NO: 1454; SEQ ID NO: 670, SEQ ID NO: 827, SEQ ID NO: 984, SEQ ID NO: 1141, SEQ ID NO: 1298, and SEQ ID NO: 1455; SEQ ID NO: 671, SEQ ID NO: 828, SEQ ID NO: 985, SEQ ID NO: 1142, SEQ ID NO: 1299, and SEQ ID NO: 1456; SEQ ID NO: 672, SEQ ID NO: 829, SEQ ID NO: 986, SEQ ID NO: 1143, SEQ ID NO: 1300, and SEQ ID NO: 1457; SEQ ID NO: 673, SEQ ID NO: 830, SEQ ID NO: 987, SEQ ID NO: 1144, SEQ ID NO: 1301, and SEQ ID NO: 1458; SEQ ID NO: 674, SEQ ID NO: 831, SEQ ID NO: 988, SEQ ID NO: 1145, SEQ ID NO: 1302, and SEQ ID NO: 1459; SEQ ID NO: 675, SEQ ID NO: 832, SEQ ID NO: 989, SEQ ID NO: 1146, SEQ ID NO: 1303, and SEQ ID NO: 1460; SEQ ID NO: 676, SEQ ID NO: 833, SEQ ID NO: 990, SEQ ID NO: 1147, SEQ ID NO: 1304, and SEQ ID NO: 1461; SEQ ID NO: 677, SEQ ID NO: 834, SEQ ID NO: 991, SEQ ID NO: 1148, SEQ ID NO: 1305, and SEQ ID NO: 1462; SEQ ID NO: 678, SEQ ID NO: 835, SEQ ID NO: 992, SEQ ID NO: 1149, SEQ ID NO: 1306, and SEQ ID NO: 1463; SEQ ID NO: 679, SEQ ID NO: 836, SEQ ID NO: 993, SEQ ID NO: 1150, SEQ ID NO: 1307, and SEQ ID NO: 1464; SEQ ID NO: 680, SEQ ID NO: 837, SEQ ID NO: 994, SEQ ID NO: 1151, SEQ ID NO: 1308, and SEQ ID NO: 1465; SEQ ID NO: 681, SEQ ID NO: 838, SEQ ID NO: 995, SEQ ID NO: 1152, SEQ ID NO: 1309, and SEQ ID NO: 1466; SEQ ID NO: 682, SEQ ID NO: 839, SEQ ID NO: 996, SEQ ID NO: 1153, SEQ ID NO: 1310, and SEQ ID NO: 1467; SEQ ID NO: 683, SEQ ID NO: 840, SEQ ID NO: 997, SEQ ID NO: 1154, SEQ ID NO: 1311, and SEQ ID NO: 1468; SEQ ID NO: 684, SEQ ID NO: 841, SEQ ID NO: 998, SEQ ID NO: 1155, SEQ ID NO: 1312, and SEQ ID NO: 1469; SEQ ID NO: 685, SEQ ID NO: 842, SEQ ID NO: 999, SEQ ID NO: 1156, SEQ ID NO: 1313, and SEQ ID NO: 1470; SEQ ID NO: 686, SEQ ID NO: 843, SEQ ID NO: 1000, SEQ ID NO: 1157, SEQ ID NO: 1314, and SEQ ID NO: 1471; SEQ ID NO: 687, SEQ ID NO: 844, SEQ ID NO: 1001, SEQ ID NO: 1158, SEQ ID NO: 1315, and SEQ ID NO: 1472; SEQ ID NO: 688, SEQ ID NO: 845, SEQ ID NO: 1002, SEQ ID NO: 1159, SEQ ID NO: 1316, and SEQ ID NO: 1473; SEQ ID NO: 689, SEQ ID NO: 846, SEQ ID NO: 1003, SEQ ID NO: 1160, SEQ ID NO: 1317, and SEQ ID NO: 1474; SEQ ID NO: 690, SEQ ID NO: 847, SEQ ID NO: 1004, SEQ ID NO: 1161, SEQ ID NO: 1318, and SEQ ID NO: 1475; SEQ ID NO: 691, SEQ ID NO: 848, SEQ ID NO: 1005, SEQ ID NO: 1162, SEQ ID NO: 1319, and SEQ ID NO: 1476; SEQ ID NO: 692, SEQ ID NO: 849, SEQ ID NO: 1006, SEQ ID NO: 1163, SEQ ID NO: 1320, and SEQ ID NO: 1477; SEQ ID NO: 693, SEQ ID NO: 850, SEQ ID NO: 1007, SEQ ID NO: 1164, SEQ ID NO: 1321, and SEQ ID NO: 1478; SEQ ID NO: 694, SEQ ID NO: 851, SEQ ID NO: 1008, SEQ ID NO: 1165, SEQ ID NO: 1322, and SEQ ID NO: 1479; SEQ ID NO: 695, SEQ ID NO: 852, SEQ ID NO: 1009, SEQ ID NO: 1166, SEQ ID NO: 1323, and SEQ ID NO: 1480; SEQ ID NO: 696, SEQ ID NO: 853, SEQ ID NO: 1010, SEQ ID NO: 1167, SEQ ID NO: 1324, and SEQ ID NO: 1481; SEQ ID NO: 697, SEQ ID NO: 854, SEQ ID NO: 1011, SEQ ID NO: 1168, SEQ ID NO: 1325, and SEQ ID NO: 1482; SEQ ID NO: 698, SEQ ID NO: 855, SEQ ID NO: 1012, SEQ ID NO: 1169, SEQ ID NO: 1326, and SEQ ID NO: 1483; SEQ ID NO: 699, SEQ ID NO: 856, SEQ ID NO: 1013, SEQ ID NO: 1170, SEQ ID NO: 1327, and SEQ ID NO: 1484; SEQ ID NO: 700, SEQ ID NO: 857, SEQ ID NO: 1014, SEQ ID NO: 1171, SEQ ID NO: 1328, and SEQ ID NO: 1485; SEQ ID NO: 701, SEQ ID NO: 858, SEQ ID NO: 1015, SEQ ID NO: 1172, SEQ ID NO: 1329, and SEQ ID NO: 1486; SEQ ID NO: 702, SEQ ID NO: 859, SEQ ID NO: 1016, SEQ ID NO: 1173, SEQ ID NO: 1330, and SEQ ID NO: 1487; SEQ ID NO: 703, SEQ ID NO: 860, SEQ ID NO: 1017, SEQ ID NO: 1174, SEQ ID NO: 1331, and SEQ ID NO: 1488; SEQ ID NO: 704, SEQ ID NO: 861, SEQ ID NO: 1018, SEQ ID NO: 1175, SEQ ID NO: 1332, and SEQ ID NO: 1489; SEQ ID NO: 705, SEQ ID NO: 862, SEQ ID NO: 1019, SEQ ID NO: 1176, SEQ ID NO: 1333, and SEQ ID NO: 1490; SEQ ID NO: 706, SEQ ID NO: 863, SEQ ID NO: 1020, SEQ ID NO: 1177, SEQ ID NO: 1334, and SEQ ID NO: 1491; SEQ ID NO: 707, SEQ ID NO: 864, SEQ ID NO: 1021, SEQ ID NO: 1178, SEQ ID NO: 1335, and SEQ ID NO: 1492; SEQ ID NO: 708, SEQ ID NO: 865, SEQ ID NO: 1022, SEQ ID NO: 1179, SEQ ID NO: 1336, and SEQ ID NO: 1493; SEQ ID NO: 709, SEQ ID NO: 866, SEQ ID NO: 1023, SEQ ID NO: 1180, SEQ ID NO: 1337, and SEQ ID NO: 1494; SEQ ID NO: 710, SEQ ID NO: 867, SEQ ID NO: 1024, SEQ ID NO: 1181, SEQ ID NO: 1338, and SEQ ID NO: 1495; SEQ ID NO: 711, SEQ ID NO: 868, SEQ ID NO: 1025, SEQ ID NO: 1182, SEQ ID NO: 1339, and SEQ ID NO: 1496; SEQ ID NO: 712, SEQ ID NO: 869, SEQ ID NO: 1026, SEQ ID NO: 1183, SEQ ID NO: 1340, and SEQ ID NO: 1497; SEQ ID NO: 713, SEQ ID NO: 870, SEQ ID NO: 1027, SEQ ID NO: 1184, SEQ ID NO: 1341, and SEQ ID NO: 1498; SEQ ID NO: 714, SEQ ID NO: 871, SEQ ID NO: 1028, SEQ ID NO: 1185, SEQ ID NO: 1342, and SEQ ID NO: 1499; SEQ ID NO: 715, SEQ ID NO: 872, SEQ ID NO: 1029, SEQ ID NO: 1186, SEQ ID NO: 1343, and SEQ ID NO: 1500; SEQ ID NO: 716, SEQ ID NO: 873, SEQ ID NO: 1030, SEQ ID NO: 1187, SEQ ID NO: 1344, and SEQ ID NO: 1501; SEQ ID NO: 717, SEQ ID NO: 874, SEQ ID NO: 1031, SEQ ID NO: 1188, SEQ ID NO: 1345, and SEQ ID NO: 1502; SEQ ID NO: 718, SEQ ID NO: 875, SEQ ID NO: 1032, SEQ ID NO: 1189, SEQ ID NO: 1346, and SEQ ID NO: 1503; SEQ ID NO: 719, SEQ ID NO: 876, SEQ ID NO: 1033, SEQ ID NO: 1190, SEQ ID NO: 1347, and SEQ ID NO: 1504; SEQ ID NO: 720, SEQ ID NO: 877, SEQ ID NO: 1034, SEQ ID NO: 1191, SEQ ID NO: 1348, and SEQ ID NO: 1505; SEQ ID NO: 721, SEQ ID NO: 878, SEQ ID NO: 1035, SEQ ID NO: 1192, SEQ ID NO: 1349, and SEQ ID NO: 1506; SEQ ID NO: 722, SEQ ID NO: 879, SEQ ID NO: 1036, SEQ ID NO: 1193, SEQ ID NO: 1350, and SEQ ID NO: 1507; SEQ ID NO: 723, SEQ ID NO: 880, SEQ ID NO: 1037, SEQ ID NO: 1194, SEQ ID NO: 1351, and SEQ ID NO: 1508; SEQ ID NO: 724, SEQ ID NO: 881, SEQ ID NO: 1038, SEQ ID NO: 1195, SEQ ID NO: 1352, and SEQ ID NO: 1509; SEQ ID NO: 725, SEQ ID NO: 882, SEQ ID NO: 1039, SEQ ID NO: 1196, SEQ ID NO: 1353, and SEQ ID NO: 1510; SEQ ID NO: 726, SEQ ID NO: 883, SEQ ID NO: 1040, SEQ ID NO: 1197, SEQ ID NO: 1354, and SEQ ID NO: 1511; SEQ ID NO: 727, SEQ ID NO: 884, SEQ ID NO: 1041, SEQ ID NO: 1198, SEQ ID NO: 1355, and SEQ ID NO: 1512; SEQ ID NO: 728, SEQ ID NO: 885, SEQ ID NO: 1042, SEQ ID NO: 1199, SEQ ID NO: 1356, and SEQ ID NO: 1513; SEQ ID NO: 729, SEQ ID NO: 886, SEQ ID NO: 1043, SEQ ID NO: 1200, SEQ ID NO: 1357, and SEQ ID NO: 1514; SEQ ID NO: 730, SEQ ID NO: 887, SEQ ID NO: 1044, SEQ ID NO: 1201, SEQ ID NO: 1358, and SEQ ID NO: 1515; SEQ ID NO: 731, SEQ ID NO: 888, SEQ ID NO: 1045, SEQ ID NO: 1202, SEQ ID NO: 1359, and SEQ ID NO: 1516; SEQ ID NO: 732, SEQ ID NO: 889, SEQ ID NO: 1046, SEQ ID NO: 1203, SEQ ID NO: 1360, and SEQ ID NO: 1517; SEQ ID NO: 733, SEQ ID NO: 890, SEQ ID NO: 1047, SEQ ID NO: 1204, SEQ ID NO: 1361, and SEQ ID NO: 1518; SEQ ID NO: 734, SEQ ID NO: 891, SEQ ID NO: 1048, SEQ ID NO: 1205, SEQ ID NO: 1362, and SEQ ID NO: 1519; SEQ ID NO: 735, SEQ ID NO: 892, SEQ ID NO: 1049, SEQ ID NO: 1206, SEQ ID NO: 1363, and SEQ ID NO: 1520; SEQ ID NO: 736, SEQ ID NO: 893, SEQ ID NO: 1050, SEQ ID NO: 1207, SEQ ID NO: 1364, and SEQ ID NO: 1521; SEQ ID NO: 737, SEQ ID NO: 894, SEQ ID NO: 1051, SEQ ID NO: 1208, SEQ ID NO: 1365, and SEQ ID NO: 1522; SEQ ID NO: 738, SEQ ID NO: 895, SEQ ID NO: 1052, SEQ ID NO: 1209, SEQ ID NO: 1366, and SEQ ID NO: 1523; SEQ ID NO: 739, SEQ ID NO: 896, SEQ ID NO: 1053, SEQ ID NO: 1210, SEQ ID NO: 1367, and SEQ ID NO: 1524; SEQ ID NO: 740, SEQ ID NO: 897, SEQ ID NO: 1054, SEQ ID NO: 1211, SEQ ID NO: 1368, and SEQ ID NO: 1525; SEQ ID NO: 741, SEQ ID NO: 898, SEQ ID NO: 1055, SEQ ID NO: 1212, SEQ ID NO: 1369, and SEQ ID NO: 1526; SEQ ID NO: 742, SEQ ID NO: 899, SEQ ID NO: 1056, SEQ ID NO: 1213, SEQ ID NO: 1370, and SEQ ID NO: 1527; SEQ ID NO: 743, SEQ ID NO: 900, SEQ ID NO: 1057, SEQ ID NO: 1214, SEQ ID NO: 1371, and SEQ ID NO: 1528; SEQ ID NO: 744, SEQ ID NO: 901, SEQ ID NO: 1058, SEQ ID NO: 1215, SEQ ID NO: 1372, and SEQ ID NO: 1529; SEQ ID NO: 745, SEQ ID NO: 902, SEQ ID NO: 1059, SEQ ID NO: 1216, SEQ ID NO: 1373, and SEQ ID NO: 1530; SEQ ID NO: 746, SEQ ID NO: 903, SEQ ID NO: 1060, SEQ ID NO: 1217, SEQ ID NO: 1374, and SEQ ID NO: 1531; SEQ ID NO: 747, SEQ ID NO: 904, SEQ ID NO: 1061, SEQ ID NO: 1218, SEQ ID NO: 1375, and SEQ ID NO: 1532; SEQ ID NO: 748, SEQ ID NO: 905, SEQ ID NO: 1062, SEQ ID NO: 1219, SEQ ID NO: 1376, and SEQ ID NO: 1533; SEQ ID NO: 749, SEQ ID NO: 906, SEQ ID NO: 1063, SEQ ID NO: 1220, SEQ ID NO: 1377, and SEQ ID NO: 1534; SEQ ID NO: 750, SEQ ID NO: 907, SEQ ID NO: 1064, SEQ ID NO: 1221, SEQ ID NO: 1378, and SEQ ID NO: 1535; SEQ ID NO: 751, SEQ ID NO: 908, SEQ ID NO: 1065, SEQ ID NO: 1222, SEQ ID NO: 1379, and SEQ ID NO: 1536; SEQ ID NO: 752, SEQ ID NO: 909, SEQ ID NO: 1066, SEQ ID NO: 1223, SEQ ID NO: 1380, and SEQ ID NO: 1537; SEQ ID NO: 753, SEQ ID NO: 910, SEQ ID NO: 1067, SEQ ID NO: 1224, SEQ ID NO: 1381, and SEQ ID NO: 1538; SEQ ID NO: 754, SEQ ID NO: 911, SEQ ID NO: 1068, SEQ ID NO: 1225, SEQ ID NO: 1382, and SEQ ID NO: 1539; SEQ ID NO: 755, SEQ ID NO: 912, SEQ ID NO: 1069, SEQ ID NO: 1226, SEQ ID NO: 1383, and SEQ ID NO: 1540; SEQ ID NO: 756, SEQ ID NO: 913, SEQ ID NO: 1070, SEQ ID NO: 1227, SEQ ID NO: 1384, and SEQ ID NO: 1541; SEQ ID NO: 757, SEQ ID NO: 914, SEQ ID NO: 1071, SEQ ID NO: 1228, SEQ ID NO: 1385, and SEQ ID NO: 1542; SEQ ID NO: 758, SEQ ID NO: 915, SEQ ID NO: 1072, SEQ ID NO: 1229, SEQ ID NO: 1386, and SEQ ID NO: 1543; SEQ ID NO: 759, SEQ ID NO: 916, SEQ ID NO: 1073, SEQ ID NO: 1230, SEQ ID NO: 1387, and SEQ ID NO: 1544; SEQ ID NO: 760, SEQ ID NO: 917, SEQ ID NO: 1074, SEQ ID NO: 1231, SEQ ID NO: 1388, and SEQ ID NO: 1545; SEQ ID NO: 761, SEQ ID NO: 918, SEQ ID NO: 1075, SEQ ID NO: 1232, SEQ ID NO: 1389, and SEQ ID NO: 1546; SEQ ID NO: 762, SEQ ID NO: 919, SEQ ID NO: 1076, SEQ ID NO: 1233, SEQ ID NO: 1390, and SEQ ID NO: 1547; SEQ ID NO: 763, SEQ ID NO: 920, SEQ ID NO: 1077, SEQ ID NO: 1234, SEQ ID NO: 1391, and SEQ ID NO: 1548; SEQ ID NO: 764, SEQ ID NO: 921, SEQ ID NO: 1078, SEQ ID NO: 1235, SEQ ID NO: 1392, and SEQ ID NO: 1549; SEQ ID NO: 765, SEQ ID NO: 922, SEQ ID NO: 1079, SEQ ID NO: 1236, SEQ ID NO: 1393, and SEQ ID NO: 1550; SEQ ID NO: 766, SEQ ID NO: 923, SEQ ID NO: 1080, SEQ ID NO: 1237, SEQ ID NO: 1394, and SEQ ID NO: 1551; SEQ ID NO: 767, SEQ ID NO: 924, SEQ ID NO: 1081, SEQ ID NO: 1238, SEQ ID NO: 1395, and SEQ ID NO: 1552; SEQ ID NO: 768, SEQ ID NO: 925, SEQ ID NO: 1082, SEQ ID NO: 1239, SEQ ID NO: 1396, and SEQ ID NO: 1553; SEQ ID NO: 769, SEQ ID NO: 926, SEQ ID NO: 1083, SEQ ID NO: 1240, SEQ ID NO: 1397, and SEQ ID NO: 1554; SEQ ID NO: 770, SEQ ID NO: 927, SEQ ID NO: 1084, SEQ ID NO: 1241, SEQ ID NO: 1398, and SEQ ID NO: 1555; SEQ ID NO: 771, SEQ ID NO: 928, SEQ ID NO: 1085, SEQ ID NO: 1242, SEQ ID NO: 1399, and SEQ ID NO: 1556; SEQ ID NO: 772, SEQ ID NO: 929, SEQ ID NO: 1086, SEQ ID NO: 1243, SEQ ID NO: 1400, and SEQ ID NO: 1557; SEQ ID NO: 773, SEQ ID NO: 930, SEQ ID NO: 1087, SEQ ID NO: 1244, SEQ ID NO: 1401, and SEQ ID NO: 1558; SEQ ID NO: 774, SEQ ID NO: 931, SEQ ID NO: 1088, SEQ ID NO: 1245, SEQ ID NO: 1402, and SEQ ID NO: 1559; SEQ ID NO: 775, SEQ ID NO: 932, SEQ ID NO: 1089, SEQ ID NO: 1246, SEQ ID NO: 1403, and SEQ ID NO: 1560; SEQ ID NO: 776, SEQ ID NO: 933, SEQ ID NO: 1090, SEQ ID NO: 1247, SEQ ID NO: 1404, and SEQ ID NO: 1561; SEQ ID NO: 777, SEQ ID NO: 934, SEQ ID NO: 1091, SEQ ID NO: 1248, SEQ ID NO: 1405, and SEQ ID NO: 1562; SEQ ID NO: 778, SEQ ID NO: 935, SEQ ID NO: 1092, SEQ ID NO: 1249, SEQ ID NO: 1406, and SEQ ID NO: 1563; SEQ ID NO: 779, SEQ ID NO: 936, SEQ ID NO: 1093, SEQ ID NO: 1250, SEQ ID NO: 1407, and SEQ ID NO: 1564; SEQ ID NO: 780, SEQ ID NO: 937, SEQ ID NO: 1094, SEQ ID NO: 1251, SEQ ID NO: 1408, and SEQ ID NO: 1565; SEQ ID NO: 781, SEQ ID NO: 938, SEQ ID NO: 1095, SEQ ID NO: 1252, SEQ ID NO: 1409, and SEQ ID NO: 1566; SEQ ID NO: 782, SEQ ID NO: 939, SEQ ID NO: 1096, SEQ ID NO: 1253, SEQ ID NO: 1410, and SEQ ID NO: 1567; SEQ ID NO: 783, SEQ ID NO: 940, SEQ ID NO: 1097, SEQ ID NO: 1254, SEQ ID NO: 1411, and SEQ ID NO: 1568; SEQ ID NO: 784, SEQ ID NO: 941, SEQ ID NO: 1098, SEQ ID NO: 1255, SEQ ID NO: 1412, and SEQ ID NO: 1569; and SEQ ID NO: 785, SEQ ID NO: 942, SEQ ID NO: 1099, SEQ ID NO: 1256, SEQ ID NO: 1413, and SEQ ID NO: 1570.

In one embodiment the antibody or fragment thereof comprises a CDRL1, a CDRL2, a CDRL3, a CDRH1, a CDRH2, and a CDRH3 encoded by a polynucleotide. In one embodiment the antibody or fragment thereof comprises a CDRL1, a CDRL2, a CDRL3, a CDRH1, a CDRH2, and a CDRH3, wherein each CDRL1, CDRL2, CDRL3, CDRH1, CDRH2, and CDRH3, respectively, is encoded by a sequence selected from the group consisting of SEQ ID NO: 2199, SEQ ID NO: 2356, SEQ ID NO: 2513, SEQ ID NO: 2670, SEQ ID NO: 2827, and SEQ ID NO: 2984; SEQ ID NO: 2200, SEQ ID NO: 2357, SEQ ID NO: 2514, SEQ ID NO: 2671, SEQ ID NO: 2828, and SEQ ID NO: 2985; SEQ ID NO: 2201, SEQ ID NO: 2358, SEQ ID NO: 2515, SEQ ID NO: 2672, SEQ ID NO: 2829, and SEQ ID NO: 2986; SEQ ID NO: 2202, SEQ ID NO: 2359, SEQ ID NO: 2516, SEQ ID NO: 2673, SEQ ID NO: 2830, and SEQ ID NO: 2987; SEQ ID NO: 2203, SEQ ID NO: 2360, SEQ ID NO: 2517, SEQ ID NO: 2674, SEQ ID NO: 2831, and SEQ ID NO: 2988; SEQ ID NO: 2204, SEQ ID NO: 2361, SEQ ID NO: 2518, SEQ ID NO: 2675, SEQ ID NO: 2832, and SEQ ID NO: 2989; SEQ ID NO: 2205, SEQ ID NO: 2362, SEQ ID NO: 2519, SEQ ID NO: 2676, SEQ ID NO: 2833, and SEQ ID NO: 2990; SEQ ID NO: 2206, SEQ ID NO: 2363, SEQ ID NO: 2520, SEQ ID NO: 2677, SEQ ID NO: 2834, and SEQ ID NO: 2991; SEQ ID NO: 2207, SEQ ID NO: 2364, SEQ ID NO: 2521, SEQ ID NO: 2678, SEQ ID NO: 2835, and SEQ ID NO: 2992; SEQ ID NO: 2208, SEQ ID NO: 2365, SEQ ID NO: 2522, SEQ ID NO: 2679, SEQ ID NO: 2836, and SEQ ID NO: 2993; SEQ ID NO: 2209, SEQ ID NO: 2366, SEQ ID NO: 2523, SEQ ID NO: 2680, SEQ ID NO: 2837, and SEQ ID NO: 2994; SEQ ID NO: 2210, SEQ ID NO: 2367, SEQ ID NO: 2524, SEQ ID NO: 2681, SEQ ID NO: 2838, and SEQ ID NO: 2995; SEQ ID NO: 2211, SEQ ID NO: 2368, SEQ ID NO: 2525, SEQ ID NO: 2682, SEQ ID NO: 2839, and SEQ ID NO: 2996; SEQ ID NO: 2212, SEQ ID NO: 2369, SEQ ID NO: 2526, SEQ ID NO: 2683, SEQ ID NO: 2840, and SEQ ID NO: 2997; SEQ ID NO: 2213, SEQ ID NO: 2370, SEQ ID NO: 2527, SEQ ID NO: 2684, SEQ ID NO: 2841, and SEQ ID NO: 2998; SEQ ID NO: 2214, SEQ ID NO: 2371, SEQ ID NO: 2528, SEQ ID NO: 2685, SEQ ID NO: 2842, and SEQ ID NO: 2999; SEQ ID NO: 2215, SEQ ID NO: 2372, SEQ ID NO: 2529, SEQ ID NO: 2686, SEQ ID NO: 2843, and SEQ ID NO: 3000; SEQ ID NO: 2216, SEQ ID NO: 2373, SEQ ID NO: 2530, SEQ ID NO: 2687, SEQ ID NO: 2844, and SEQ ID NO: 3001; SEQ ID NO: 2217, SEQ ID NO: 2374, SEQ ID NO: 2531, SEQ ID NO: 2688, SEQ ID NO: 2845, and SEQ ID NO: 3002; SEQ ID NO: 2218, SEQ ID NO: 2375, SEQ ID NO: 2532, SEQ ID NO: 2689, SEQ ID NO: 2846, and SEQ ID NO: 3003; SEQ ID NO: 2219, SEQ ID NO: 2376, SEQ ID NO: 2533, SEQ ID NO: 2690, SEQ ID NO: 2847, and SEQ ID NO: 3004; SEQ ID NO: 2220, SEQ ID NO: 2377, SEQ ID NO: 2534, SEQ ID NO: 2691, SEQ ID NO: 2848, and SEQ ID NO: 3005; SEQ ID NO: 2221, SEQ ID NO: 2378, SEQ ID NO: 2535, SEQ ID NO: 2692, SEQ ID NO: 2849, and SEQ ID NO: 3006; SEQ ID NO: 2222, SEQ ID NO: 2379, SEQ ID NO: 2536, SEQ ID NO: 2693, SEQ ID NO: 2850, and SEQ ID NO: 3007; SEQ ID NO: 2223, SEQ ID NO: 2380, SEQ ID NO: 2537, SEQ ID NO: 2694, SEQ ID NO: 2851, and SEQ ID NO: 3008; SEQ ID NO: 2224, SEQ ID NO: 2381, SEQ ID NO: 2538, SEQ ID NO: 2695, SEQ ID NO: 2852, and SEQ ID NO: 3009; SEQ ID NO: 2225, SEQ ID NO: 2382, SEQ ID NO: 2539, SEQ ID NO: 2696, SEQ ID NO: 2853, and SEQ ID NO: 3010; SEQ ID NO: 2226, SEQ ID NO: 2383, SEQ ID NO: 2540, SEQ ID NO: 2697, SEQ ID NO: 2854, and SEQ ID NO: 3011; SEQ ID NO: 2227, SEQ ID NO: 2384, SEQ ID NO: 2541, SEQ ID NO: 2698, SEQ ID NO: 2855, and SEQ ID NO: 3012; SEQ ID NO: 2228, SEQ ID NO: 2385, SEQ ID NO: 2542, SEQ ID NO: 2699, SEQ ID NO: 2856, and SEQ ID NO: 3013; SEQ ID NO: 2229, SEQ ID NO: 2386, SEQ ID NO: 2543, SEQ ID NO: 2700, SEQ ID NO: 2857, and SEQ ID NO: 3014; SEQ ID NO: 2230, SEQ ID NO: 2387, SEQ ID NO: 2544, SEQ ID NO: 2701, SEQ ID NO: 2858, and SEQ ID NO: 3015; SEQ ID NO: 2231, SEQ ID NO: 2388, SEQ ID NO: 2545, SEQ ID NO: 2702, SEQ ID NO: 2859, and SEQ ID NO: 3016; SEQ ID NO: 2232, SEQ ID NO: 2389, SEQ ID NO: 2546, SEQ ID NO: 2703, SEQ ID NO: 2860, and SEQ ID NO: 3017; SEQ ID NO: 2233, SEQ ID NO: 2390, SEQ ID NO: 2547, SEQ ID NO: 2704, SEQ ID NO: 2861, and SEQ ID NO: 3018; SEQ ID NO: 2234, SEQ ID NO: 2391, SEQ ID NO: 2548, SEQ ID NO: 2705, SEQ ID NO: 2862, and SEQ ID NO: 3019; SEQ ID NO: 2235, SEQ ID NO: 2392, SEQ ID NO: 2549, SEQ ID NO: 2706, SEQ ID NO: 2863, and SEQ ID NO: 3020; SEQ ID NO: 2236, SEQ ID NO: 2393, SEQ ID NO: 2550, SEQ ID NO: 2707, SEQ ID NO: 2864, and SEQ ID NO: 3021; SEQ ID NO: 2237, SEQ ID NO: 2394, SEQ ID NO: 2551, SEQ ID NO: 2708, SEQ ID NO: 2865, and SEQ ID NO: 3022; SEQ ID NO: 2238, SEQ ID NO: 2395, SEQ ID NO: 2552, SEQ ID NO: 2709, SEQ ID NO: 2866, and SEQ ID NO: 3023; SEQ ID NO: 2239, SEQ ID NO: 2396, SEQ ID NO: 2553, SEQ ID NO: 2710, SEQ ID NO: 2867, and SEQ ID NO: 3024; SEQ ID NO: 2240, SEQ ID NO: 2397, SEQ ID NO: 2554, SEQ ID NO: 2711, SEQ ID NO: 2868, and SEQ ID NO: 3025; SEQ ID NO: 2241, SEQ ID NO: 2398, SEQ ID NO: 2555, SEQ ID NO: 2712, SEQ ID NO: 2869, and SEQ ID NO: 3026; SEQ ID NO: 2242, SEQ ID NO: 2399, SEQ ID NO: 2556, SEQ ID NO: 2713, SEQ ID NO: 2870, and SEQ ID NO: 3027; SEQ ID NO: 2243, SEQ ID NO: 2400, SEQ ID NO: 2557, SEQ ID NO: 2714, SEQ ID NO: 2871, and SEQ ID NO: 3028; SEQ ID NO: 2244, SEQ ID NO: 2401, SEQ ID NO: 2558, SEQ ID NO: 2715, SEQ ID NO: 2872, and SEQ ID NO: 3029; SEQ ID NO: 2245, SEQ ID NO: 2402, SEQ ID NO: 2559, SEQ ID NO: 2716, SEQ ID NO: 2873, and SEQ ID NO: 3030; SEQ ID NO: 2246, SEQ ID NO: 2403, SEQ ID NO: 2560, SEQ ID NO: 2717, SEQ ID NO: 2874, and SEQ ID NO: 3031; SEQ ID NO: 2247, SEQ ID NO: 2404, SEQ ID NO: 2561, SEQ ID NO: 2718, SEQ ID NO: 2875, and SEQ ID NO: 3032; SEQ ID NO: 2248, SEQ ID NO: 2405, SEQ ID NO: 2562, SEQ ID NO: 2719, SEQ ID NO: 2876, and SEQ ID NO: 3033; SEQ ID NO: 2249, SEQ ID NO: 2406, SEQ ID NO: 2563, SEQ ID NO: 2720, SEQ ID NO: 2877, and SEQ ID NO: 3034; SEQ ID NO: 2250, SEQ ID NO: 2407, SEQ ID NO: 2564, SEQ ID NO: 2721, SEQ ID NO: 2878, and SEQ ID NO: 3035; SEQ ID NO: 2251, SEQ ID NO: 2408, SEQ ID NO: 2565, SEQ ID NO: 2722, SEQ ID NO: 2879, and SEQ ID NO: 3036; SEQ ID NO: 2252, SEQ ID NO: 2409, SEQ ID NO: 2566, SEQ ID NO: 2723, SEQ ID NO: 2880, and SEQ ID NO: 3037; SEQ ID NO: 2253, SEQ ID NO: 2410, SEQ ID NO: 2567, SEQ ID NO: 2724, SEQ ID NO: 2881, and SEQ ID NO: 3038; SEQ ID NO: 2254, SEQ ID NO: 2411, SEQ ID NO: 2568, SEQ ID NO: 2725, SEQ ID NO: 2882, and SEQ ID NO: 3039; SEQ ID NO: 2255, SEQ ID NO: 2412, SEQ ID NO: 2569, SEQ ID NO: 2726, SEQ ID NO: 2883, and SEQ ID NO: 3040; SEQ ID NO: 2256, SEQ ID NO: 2413, SEQ ID NO: 2570, SEQ ID NO: 2727, SEQ ID NO: 2884, and SEQ ID NO: 3041; SEQ ID NO: 2257, SEQ ID NO: 2414, SEQ ID NO: 2571, SEQ ID NO: 2728, SEQ ID NO: 2885, and SEQ ID NO: 3042; SEQ ID NO: 2258, SEQ ID NO: 2415, SEQ ID NO: 2572, SEQ ID NO: 2729, SEQ ID NO: 2886, and SEQ ID NO: 3043; SEQ ID NO: 2259, SEQ ID NO: 2416, SEQ ID NO: 2573, SEQ ID NO: 2730, SEQ ID NO: 2887, and SEQ ID NO: 3044; SEQ ID NO: 2260, SEQ ID NO: 2417, SEQ ID NO: 2574, SEQ ID NO: 2731, SEQ ID NO: 2888, and SEQ ID NO: 3045; SEQ ID NO: 2261, SEQ ID NO: 2418, SEQ ID NO: 2575, SEQ ID NO: 2732, SEQ ID NO: 2889, and SEQ ID NO: 3046; SEQ ID NO: 2262, SEQ ID NO: 2419, SEQ ID NO: 2576, SEQ ID NO: 2733, SEQ ID NO: 2890, and SEQ ID NO: 3047; SEQ ID NO: 2263, SEQ ID NO: 2420, SEQ ID NO: 2577, SEQ ID NO: 2734, SEQ ID NO: 2891, and SEQ ID NO: 3048; SEQ ID NO: 2264, SEQ ID NO: 2421, SEQ ID NO: 2578, SEQ ID NO: 2735, SEQ ID NO: 2892, and SEQ ID NO: 3049; SEQ ID NO: 2265, SEQ ID NO: 2422, SEQ ID NO: 2579, SEQ ID NO: 2736, SEQ ID NO: 2893, and SEQ ID NO: 3050; SEQ ID NO: 2266, SEQ ID NO: 2423, SEQ ID NO: 2580, SEQ ID NO: 2737, SEQ ID NO: 2894, and SEQ ID NO: 3051; SEQ ID NO: 2267, SEQ ID NO: 2424, SEQ ID NO: 2581, SEQ ID NO: 2738, SEQ ID NO: 2895, and SEQ ID NO: 3052; SEQ ID NO: 2268, SEQ ID NO: 2425, SEQ ID NO: 2582, SEQ ID NO: 2739, SEQ ID NO: 2896, and SEQ ID NO: 3053; SEQ ID NO: 2269, SEQ ID NO: 2426, SEQ ID NO: 2583, SEQ ID NO: 2740, SEQ ID NO: 2897, and SEQ ID NO: 3054; SEQ ID NO: 2270, SEQ ID NO: 2427, SEQ ID NO: 2584, SEQ ID NO: 2741, SEQ ID NO: 2898, and SEQ ID NO: 3055; SEQ ID NO: 2271, SEQ ID NO: 2428, SEQ ID NO: 2585, SEQ ID NO: 2742, SEQ ID NO: 2899, and SEQ ID NO: 3056; SEQ ID NO: 2272, SEQ ID NO: 2429, SEQ ID NO: 2586, SEQ ID NO: 2743, SEQ ID NO: 2900, and SEQ ID NO: 3057; SEQ ID NO: 2273, SEQ ID NO: 2430, SEQ ID NO: 2587, SEQ ID NO: 2744, SEQ ID NO: 2901, and SEQ ID NO: 3058; SEQ ID NO: 2274, SEQ ID NO: 2431, SEQ ID NO: 2588, SEQ ID NO: 2745, SEQ ID NO: 2902, and SEQ ID NO: 3059; SEQ ID NO: 2275, SEQ ID NO: 2432, SEQ ID NO: 2589, SEQ ID NO: 2746, SEQ ID NO: 2903, and SEQ ID NO: 3060; SEQ ID NO: 2276, SEQ ID NO: 2433, SEQ ID NO: 2590, SEQ ID NO: 2747, SEQ ID NO: 2904, and SEQ ID NO: 3061; SEQ ID NO: 2277, SEQ ID NO: 2434, SEQ ID NO: 2591, SEQ ID NO: 2748, SEQ ID NO: 2905, and SEQ ID NO: 3062; SEQ ID NO: 2278, SEQ ID NO: 2435, SEQ ID NO: 2592, SEQ ID NO: 2749, SEQ ID NO: 2906, and SEQ ID NO: 3063; SEQ ID NO: 2279, SEQ ID NO: 2436, SEQ ID NO: 2593, SEQ ID NO: 2750, SEQ ID NO: 2907, and SEQ ID NO: 3064; SEQ ID NO: 2280, SEQ ID NO: 2437, SEQ ID NO: 2594, SEQ ID NO: 2751, SEQ ID NO: 2908, and SEQ ID NO: 3065; SEQ ID NO: 2281, SEQ ID NO: 2438, SEQ ID NO: 2595, SEQ ID NO: 2752, SEQ ID NO: 2909, and SEQ ID NO: 3066; SEQ ID NO: 2282, SEQ ID NO: 2439, SEQ ID NO: 2596, SEQ ID NO: 2753, SEQ ID NO: 2910, and SEQ ID NO: 3067; SEQ ID NO: 2283, SEQ ID NO: 2440, SEQ ID NO: 2597, SEQ ID NO: 2754, SEQ ID NO: 2911, and SEQ ID NO: 3068; SEQ ID NO: 2284, SEQ ID NO: 2441. SEQ ID NO: 2598, SEQ ID NO: 2755, SEQ ID NO: 2912, and SEQ ID NO: 3069; SEQ ID NO: 2285, SEQ ID NO: 2442, SEQ ID NO: 2599, SEQ ID NO: 2756, SEQ ID NO: 2913, and SEQ ID NO: 3070; SEQ ID NO: 2286, SEQ ID NO: 2443, SEQ ID NO: 2600, SEQ ID NO: 2757, SEQ ID NO: 2914, and SEQ ID NO: 3071; SEQ ID NO: 2287, SEQ ID NO: 2444, SEQ ID NO: 2601, SEQ ID NO: 2758, SEQ ID NO: 2915, and SEQ ID NO: 3072; SEQ ID NO: 2288, SEQ ID NO: 2445, SEQ ID NO: 2602, SEQ ID NO: 2759, SEQ ID NO: 2916, and SEQ ID NO: 3073; SEQ ID NO: 2289, SEQ ID NO: 2446, SEQ ID NO: 2603, SEQ ID NO: 2760, SEQ ID NO: 2917, and SEQ ID NO: 3074; SEQ ID NO: 2290, SEQ ID NO: 2447, SEQ ID NO: 2604, SEQ ID NO: 2761, SEQ ID NO: 2918, and SEQ ID NO: 3075; SEQ ID NO: 2291, SEQ ID NO: 2448, SEQ ID NO: 2605, SEQ ID NO: 2762, SEQ ID NO: 2919, and SEQ ID NO: 3076; SEQ ID NO: 2292, SEQ ID NO: 2449, SEQ ID NO: 2606, SEQ ID NO: 2763, SEQ ID NO: 2920, and SEQ ID NO: 3077; SEQ ID NO: 2293, SEQ ID NO: 2450, SEQ ID NO: 2607, SEQ ID NO: 2764, SEQ ID NO: 2921, and SEQ ID NO: 3078; SEQ ID NO: 2294, SEQ ID NO: 2451, SEQ ID NO: 2608, SEQ ID NO: 2765, SEQ ID NO: 2922, and SEQ ID NO: 3079; SEQ ID NO: 2295, SEQ ID NO: 2452, SEQ ID NO: 2609, SEQ ID NO: 2766, SEQ ID NO: 2923, and SEQ ID NO: 3080; SEQ ID NO: 2296, SEQ ID NO: 2453, SEQ ID NO: 2610, SEQ ID NO: 2767, SEQ ID NO: 2924, and SEQ ID NO: 3081; SEQ ID NO: 2297, SEQ ID NO: 2454, SEQ ID NO: 2611, SEQ ID NO: 2768, SEQ ID NO: 2925, and SEQ ID NO: 3082; SEQ ID NO: 2298, SEQ ID NO: 2455, SEQ ID NO: 2612, SEQ ID NO: 2769, SEQ ID NO: 2926, and SEQ ID NO: 3083; SEQ ID NO: 2299, SEQ ID NO: 2456, SEQ ID NO: 2613, SEQ ID NO: 2770, SEQ ID NO: 2927, and SEQ ID NO: 3084; SEQ ID NO: 2300, SEQ ID NO: 2457, SEQ ID NO: 2614, SEQ ID NO: 2771, SEQ ID NO: 2928, and SEQ ID NO: 3085; SEQ ID NO: 2301, SEQ ID NO: 2458, SEQ ID NO: 2615, SEQ ID NO: 2772, SEQ ID NO: 2929, and SEQ ID NO: 3086; SEQ ID NO: 2302, SEQ ID NO: 2459, SEQ ID NO: 2616, SEQ ID NO: 2773, SEQ ID NO: 2930, and SEQ ID NO: 3087; SEQ ID NO: 2303, SEQ ID NO: 2460, SEQ ID NO: 2617, SEQ ID NO: 2774, SEQ ID NO: 2931, and SEQ ID NO: 3088; SEQ ID NO: 2304, SEQ ID NO: 2461, SEQ ID NO: 2618, SEQ ID NO: 2775, SEQ ID NO: 2932, and SEQ ID NO: 3089; SEQ ID NO: 2305, SEQ ID NO: 2462, SEQ ID NO: 2619, SEQ ID NO: 2776, SEQ ID NO: 2933, and SEQ ID NO: 3090; SEQ ID NO: 2306, SEQ ID NO: 2463, SEQ ID NO: 2620, SEQ ID NO: 2777, SEQ ID NO: 2934, and SEQ ID NO: 3091; SEQ ID NO: 2307, SEQ ID NO: 2464, SEQ ID NO: 2621, SEQ ID NO: 2778, SEQ ID NO: 2935, and SEQ ID NO: 3092; SEQ ID NO: 2308, SEQ ID NO: 2465, SEQ ID NO: 2622, SEQ ID NO: 2779, SEQ ID NO: 2936, and SEQ ID NO: 3093; SEQ ID NO: 2309, SEQ ID NO: 2466, SEQ ID NO: 2623, SEQ ID NO: 2780, SEQ ID NO: 2937, and SEQ ID NO: 3094; SEQ ID NO: 2310, SEQ ID NO: 2467, SEQ ID NO: 2624, SEQ ID NO: 2781, SEQ ID NO: 2938, and SEQ ID NO: 3095; SEQ ID NO: 2311, SEQ ID NO: 2468, SEQ ID NO: 2625, SEQ ID NO: 2782, SEQ ID NO: 2939, and SEQ ID NO: 3096; SEQ ID NO: 2312, SEQ ID NO: 2469, SEQ ID NO: 2626, SEQ ID NO: 2783, SEQ ID NO: 2940, and SEQ ID NO: 3097; SEQ ID NO: 2313, SEQ ID NO: 2470, SEQ ID NO: 2627, SEQ ID NO: 2784, SEQ ID NO: 2941, and SEQ ID NO: 3098; SEQ ID NO: 2314, SEQ ID NO: 2471, SEQ ID NO: 2628, SEQ ID NO: 2785, SEQ ID NO: 2942, and SEQ ID NO: 3099; SEQ ID NO: 2315, SEQ ID NO: 2472, SEQ ID NO: 2629, SEQ ID NO: 2786, SEQ ID NO: 2943, and SEQ ID NO: 3100; SEQ ID NO: 2316, SEQ ID NO: 2473, SEQ ID NO: 2630, SEQ ID NO: 2787, SEQ ID NO: 2944, and SEQ ID NO: 3101; SEQ ID NO: 2317, SEQ ID NO: 2474, SEQ ID NO: 2631, SEQ ID NO: 2788, SEQ ID NO: 2945, and SEQ ID NO: 3102; SEQ ID NO: 2318, SEQ ID NO: 2475, SEQ ID NO: 2632, SEQ ID NO: 2789, SEQ ID NO: 2946, and SEQ ID NO: 3103; SEQ ID NO: 2319, SEQ ID NO: 2476, SEQ ID NO: 2633, SEQ ID NO: 2790, SEQ ID NO: 2947, and SEQ ID NO: 3104; SEQ ID NO: 2320, SEQ ID NO: 2477, SEQ ID NO: 2634, SEQ ID NO: 2791, SEQ ID NO: 2948, and SEQ ID NO: 3105; SEQ ID NO: 2321, SEQ ID NO: 2478, SEQ ID NO: 2635, SEQ ID NO: 2792, SEQ ID NO: 2949, and SEQ ID NO: 3106; SEQ ID NO: 2322, SEQ ID NO: 2479, SEQ ID NO: 2636, SEQ ID NO: 2793, SEQ ID NO: 2950, and SEQ ID NO: 3107; SEQ ID NO: 2323, SEQ ID NO: 2480, SEQ ID NO: 2637, SEQ ID NO: 2794, SEQ ID NO: 2951, and SEQ ID NO: 3108; SEQ ID NO: 2324, SEQ ID NO: 2481, SEQ ID NO: 2638, SEQ ID NO: 2795, SEQ ID NO: 2952, and SEQ ID NO: 3109; SEQ ID NO: 2325, SEQ ID NO: 2482, SEQ ID NO: 2639, SEQ ID NO: 2796, SEQ ID NO: 2953, and SEQ ID NO: 3110; SEQ ID NO: 2326, SEQ ID NO: 2483, SEQ ID NO: 2640, SEQ ID NO: 2797, SEQ ID NO: 2954, and SEQ ID NO: 3111; SEQ ID NO: 2327, SEQ ID NO: 2484, SEQ ID NO: 2641, SEQ ID NO: 2798, SEQ ID NO: 2955, and SEQ ID NO: 3112; SEQ ID NO: 2328, SEQ ID NO: 2485, SEQ ID NO: 2642, SEQ ID NO: 2799, SEQ ID NO: 2956, and SEQ ID NO: 3113; SEQ ID NO: 2329, SEQ ID NO: 2486, SEQ ID NO: 2643, SEQ ID NO: 2800, SEQ ID NO: 2957, and SEQ ID NO: 3114; SEQ ID NO: 2330, SEQ ID NO: 2487, SEQ ID NO: 2644, SEQ ID NO: 2801, SEQ ID NO: 2958, and SEQ ID NO: 3115; SEQ ID NO: 2331, SEQ ID NO: 2488, SEQ ID NO: 2645, SEQ ID NO: 2802, SEQ ID NO: 2959, and SEQ ID NO: 3116; SEQ ID NO: 2332, SEQ ID NO: 2489, SEQ ID NO: 2646, SEQ ID NO: 2803, SEQ ID NO: 2960, and SEQ ID NO: 3117; SEQ ID NO: 2333, SEQ ID NO: 2490, SEQ ID NO: 2647, SEQ ID NO: 2804, SEQ ID NO: 2961, and SEQ ID NO: 3118; SEQ ID NO: 2334, SEQ ID NO: 2491, SEQ ID NO: 2648, SEQ ID NO: 2805, SEQ ID NO: 2962, and SEQ ID NO: 3119; SEQ ID NO: 2335, SEQ ID NO: 2492, SEQ ID NO: 2649, SEQ ID NO: 2806, SEQ ID NO: 2963, and SEQ ID NO: 3120; SEQ ID NO: 2336, SEQ ID NO: 2493, SEQ ID NO: 2650, SEQ ID NO: 2807, SEQ ID NO: 2964, and SEQ ID NO: 3121; SEQ ID NO: 2337, SEQ ID NO: 2494, SEQ ID NO: 2651, SEQ ID NO: 2808, SEQ ID NO: 2965, and SEQ ID NO: 3122; SEQ ID NO: 2338, SEQ ID NO: 2495, SEQ ID NO: 2652, SEQ ID NO: 2809, SEQ ID NO: 2966, and SEQ ID NO: 3123; SEQ ID NO: 2339, SEQ ID NO: 2496, SEQ ID NO: 2653, SEQ ID NO: 2810, SEQ ID NO: 2967, and SEQ ID NO: 3124; SEQ ID NO: 2340, SEQ ID NO: 2497, SEQ ID NO: 2654, SEQ ID NO: 2811, SEQ ID NO: 2968, and SEQ ID NO: 3125; SEQ ID NO: 2341, SEQ ID NO: 2498, SEQ ID NO: 2655, SEQ ID NO: 2812, SEQ ID NO: 2969, and SEQ ID NO: 3126; SEQ ID NO: 2342, SEQ ID NO: 2499, SEQ ID NO: 2656, SEQ ID NO: 2813, SEQ ID NO: 2970, and SEQ ID NO: 3127; SEQ ID NO: 2343, SEQ ID NO: 2500, SEQ ID NO: 2657, SEQ ID NO: 2814, SEQ ID NO: 2971, and SEQ ID NO: 3128; SEQ ID NO: 2344, SEQ ID NO: 2501, SEQ ID NO: 2658, SEQ ID NO: 2815, SEQ ID NO: 2972, and SEQ ID NO: 3129; SEQ ID NO: 2345, SEQ ID NO: 2502, SEQ ID NO: 2659, SEQ ID NO: 2816, SEQ ID NO: 2973, and SEQ ID NO: 3130; SEQ ID NO: 2346, SEQ ID NO: 2503, SEQ ID NO: 2660, SEQ ID NO: 2817, SEQ ID NO: 2974, and SEQ ID NO: 3131; SEQ ID NO: 2347, SEQ ID NO: 2504, SEQ ID NO: 2661, SEQ ID NO: 2818, SEQ ID NO: 2975, and SEQ ID NO: 3132; SEQ ID NO: 2348, SEQ ID NO: 2505, SEQ ID NO: 2662, SEQ ID NO: 2819, SEQ ID NO: 2976, and SEQ ID NO: 3133; SEQ ID NO: 2349, SEQ ID NO: 2506, SEQ ID NO: 2663, SEQ ID NO: 2820, SEQ ID NO: 2977, and SEQ ID NO: 3134; SEQ ID NO: 2350, SEQ ID NO: 2507, SEQ ID NO: 2664, SEQ ID NO: 2821, SEQ ID NO: 2978, and SEQ ID NO: 3135; SEQ ID NO: 2351, SEQ ID NO: 2508, SEQ ID NO: 2665, SEQ ID NO: 2822, SEQ ID NO: 2979, and SEQ ID NO: 3136; SEQ ID NO: 2352, SEQ ID NO: 2509, SEQ ID NO: 2666, SEQ ID NO: 2823, SEQ ID NO: 2980, and SEQ ID NO: 3137; SEQ ID NO: 2353, SEQ ID NO: 2510. SEQ ID NO: 2667, SEQ ID NO: 2824, SEQ ID NO: 2981, and SEQ ID NO: 3138; SEQ ID NO: 2354, SEQ ID NO: 2511, SEQ ID NO: 2668, SEQ ID NO: 2825, SEQ ID NO: 2982, and SEQ ID NO: 3139; and SEQ ID NO: 2355, SEQ ID NO: 2512, SEQ ID NO: 2669, SEQ ID NO: 2826, SEQ ID NO: 2983, and SEQ ID NO: 3140.

In another aspect, an antigen binding protein includes 1, 2, 3, 4, 5, or 6 variant forms of the CDRs listed in TABLES 4A and 4B, each having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in TABLES 4A and 4B, each or collectively differing by no more than 1, 2, 3, 4 or 5 amino acids from the CDRs listed in this table.

In various other embodiments, the antigen binding protein is derived from such antibodies. For instance, in one aspect, the antigen binding protein comprises 1, 2, 3, 4, 5 or all 6 of the CDRs listed in one of the rows for any particular antibody listed in TABLES 4A and 4B. In another aspect, an antigen binding protein includes 1, 2, 3, 4, 5, or 6 variant forms of the CDRs listed in one of the rows for an antibody in TABLES 4A and 4B, each CDR having at least 80%, 85%, 90%, 95%, 96%, 97%, 98%, or 99% sequence identity to a CDR sequence listed in TABLES 4A and 4B. Some antigen binding proteins include 1, 2, 3, 4, 5, or 6 of the CDRs listed in one of the rows of TABLES 4A and 4B, each differing by no more than 1, 2, 3, 4 or 5 amino acids from the CDRs listed in these tables. In another aspect, the antigen binding protein comprises all 6 of the CDRS listed in a row of TABLES 4A and 4B and the total number of amino acid changes to the CDRs collectively is no more than 1, 2, 3, 4, or 5 amino acids.

In one embodiment the antibody or fragment thereof comprises a light chain comprising a sequence selected from the group consisting of SEQ ID NOs: 315-471 and a heavy chain comprising a sequence selected from the group consisting of SEQ ID NOs: 472-628. In one embodiment the antibody or fragment thereof comprises a combination of a light chain and a heavy chain selected from the group consisting of a light chain comprising SEQ ID NO: 315 and a heavy chain comprising SEQ ID NO: 472; a light chain comprising SEQ ID NO: 316 and a heavy chain comprising SEQ ID NO: 473; a light chain comprising SEQ ID NO: 317 and a heavy chain comprising SEQ ID NO: 474; a light chain comprising SEQ ID NO: 318 and a heavy chain comprising SEQ ID NO: 475; a light chain comprising SEQ ID NO: 319 and a heavy chain comprising SEQ ID NO: 476; a light chain comprising SEQ ID NO: 320 and a heavy chain comprising SEQ ID NO: 477; a light chain comprising SEQ ID NO: 321 and a heavy chain comprising SEQ ID NO: 478; a light chain comprising SEQ ID NO: 322 and a heavy chain comprising SEQ ID NO: 479; a light chain comprising SEQ ID NO: 323 and a heavy chain comprising SEQ ID NO: 480; a light chain comprising SEQ ID NO: 324 and a heavy chain comprising SEQ ID NO: 481; a light chain comprising SEQ ID NO: 325 and a heavy chain comprising SEQ ID NO: 482; a light chain comprising SEQ ID NO: 326 and a heavy chain comprising SEQ ID NO: 483; a light chain comprising SEQ ID NO: 327 and a heavy chain comprising SEQ ID NO: 484; a light chain comprising SEQ ID NO: 328 and a heavy chain comprising SEQ ID NO: 485; a light chain comprising SEQ ID NO: 329 and a heavy chain comprising SEQ ID NO: 486; a light chain comprising SEQ ID NO: 330 and a heavy chain comprising SEQ ID NO: 487; a light chain comprising SEQ ID NO: 331 and a heavy chain comprising SEQ ID NO: 488; a light chain comprising SEQ ID NO: 332 and a heavy chain comprising SEQ ID NO: 489; a light chain comprising SEQ ID NO: 333 and a heavy chain comprising SEQ ID NO: 490; a light chain comprising SEQ ID NO: 334 and a heavy chain comprising SEQ ID NO: 491; a light chain comprising SEQ ID NO: 335 and a heavy chain comprising SEQ ID NO: 492; a light chain comprising SEQ ID NO: 336 and a heavy chain comprising SEQ ID NO: 493; a light chain comprising SEQ ID NO: 337 and a heavy chain comprising SEQ ID NO: 494; a light chain comprising SEQ ID NO: 338 and a heavy chain comprising SEQ ID NO: 495; a light chain comprising SEQ ID NO: 339 and a heavy chain comprising SEQ ID NO: 496; a light chain comprising SEQ ID NO: 340 and a heavy chain comprising SEQ ID NO: 497; a light chain comprising SEQ ID NO: 341 and a heavy chain comprising SEQ ID NO: 498; a light chain comprising SEQ ID NO: 342 and a heavy chain comprising SEQ ID NO: 499; a light chain comprising SEQ ID NO: 343 and a heavy chain comprising SEQ ID NO: 500; a light chain comprising SEQ ID NO: 344 and a heavy chain comprising SEQ ID NO: 501; a light chain comprising SEQ ID NO: 345 and a heavy chain comprising SEQ ID NO: 502; a light chain comprising SEQ ID NO: 346 and a heavy chain comprising SEQ ID NO: 503; a light chain comprising SEQ ID NO: 347 and a heavy chain comprising SEQ ID NO: 504; a light chain comprising SEQ ID NO: 348 and a heavy chain comprising SEQ ID NO: 505; a light chain comprising SEQ ID NO: 349 and a heavy chain comprising SEQ ID NO: 506; a light chain comprising SEQ ID NO: 350 and a heavy chain comprising SEQ ID NO: 507; a light chain comprising SEQ ID NO: 351 and a heavy chain comprising SEQ ID NO: 508; a light chain comprising SEQ ID NO: 352 and a heavy chain comprising SEQ ID NO: 509; a light chain comprising SEQ ID NO: 353 and a heavy chain comprising SEQ ID NO: 510; a light chain comprising SEQ ID NO: 354 and a heavy chain comprising SEQ ID NO: 511; a light chain comprising SEQ ID NO: 355 and a heavy chain comprising SEQ ID NO: 512; a light chain comprising SEQ ID NO: 356 and a heavy chain comprising SEQ ID NO: 513; a light chain comprising SEQ ID NO: 357 and a heavy chain comprising SEQ ID NO: 514; a light chain comprising SEQ ID NO: 358 and a heavy chain comprising SEQ ID NO: 515; a light chain comprising SEQ ID NO: 359 and a heavy chain comprising SEQ ID NO: 516; a light chain comprising SEQ ID NO: 360 and a heavy chain comprising SEQ ID NO: 517; a light chain comprising SEQ ID NO: 361 and a heavy chain comprising SEQ ID NO: 518; a light chain comprising SEQ ID NO: 362 and a heavy chain comprising SEQ ID NO: 519; a light chain comprising SEQ ID NO: 363 and a heavy chain comprising SEQ ID NO: 520; a light chain comprising SEQ ID NO: 364 and a heavy chain comprising SEQ ID NO: 521; a light chain comprising SEQ ID NO: 365 and a heavy chain comprising SEQ ID NO: 522; a light chain comprising SEQ ID NO: 366 and a heavy chain comprising SEQ ID NO: 523; a light chain comprising SEQ ID NO: 367 and a heavy chain comprising SEQ ID NO: 524; a light chain comprising SEQ ID NO: 368 and a heavy chain comprising SEQ ID NO: 525; a light chain comprising SEQ ID NO: 369 and a heavy chain comprising SEQ ID NO: 526; a light chain comprising SEQ ID NO: 370 and a heavy chain comprising SEQ ID NO: 527; a light chain comprising SEQ ID NO: 371 and a heavy chain comprising SEQ ID NO: 528; a light chain comprising SEQ ID NO: 372 and a heavy chain comprising SEQ ID NO: 529; a light chain comprising SEQ ID NO: 373 and a heavy chain comprising SEQ ID NO: 530; a light chain comprising SEQ ID NO: 374 and a heavy chain comprising SEQ ID NO: 531; a light chain comprising SEQ ID NO: 375 and a heavy chain comprising SEQ ID NO: 532; a light chain comprising SEQ ID NO: 376 and a heavy chain comprising SEQ ID NO: 533; a light chain comprising SEQ ID NO: 377 and a heavy chain comprising SEQ ID NO: 534; a light chain comprising SEQ ID NO: 378 and a heavy chain comprising SEQ ID NO: 535; a light chain comprising SEQ ID NO: 379 and a heavy chain comprising SEQ ID NO: 536; a light chain comprising SEQ ID NO: 380 and a heavy chain comprising SEQ ID NO: 537; a light chain comprising SEQ ID NO: 381 and a heavy chain comprising SEQ ID NO: 538; a light chain comprising SEQ ID NO: 382 and a heavy chain comprising SEQ ID NO: 539; a light chain comprising SEQ ID NO: 383 and a heavy chain comprising SEQ ID NO: 540; a light chain comprising SEQ ID NO: 384 and a heavy chain comprising SEQ ID NO: 541; a light chain comprising SEQ ID NO: 385 and a heavy chain comprising SEQ ID NO: 542; a light chain comprising SEQ ID NO: 386 and a heavy chain comprising SEQ ID NO: 543; a light chain comprising SEQ ID NO: 387 and a heavy chain comprising SEQ ID NO: 544; a light chain comprising SEQ ID NO: 388 and a heavy chain comprising SEQ ID NO: 545; a light chain comprising SEQ ID NO: 389 and a heavy chain comprising SEQ ID NO: 546; a light chain comprising SEQ ID NO: 390 and a heavy chain comprising SEQ ID NO: 547; a light chain comprising SEQ ID NO: 391 and a heavy chain comprising SEQ ID NO: 548; a light chain comprising SEQ ID NO: 392 and a heavy chain comprising SEQ ID NO: 549; a light chain comprising SEQ ID NO: 393 and a heavy chain comprising SEQ ID NO: 550; a light chain comprising SEQ ID NO: 394 and a heavy chain comprising SEQ ID NO: 551; a light chain comprising SEQ ID NO: 395 and a heavy chain comprising SEQ ID NO: 552; a light chain comprising SEQ ID NO: 396 and a heavy chain comprising SEQ ID NO: 553; a light chain comprising SEQ ID NO: 397 and a heavy chain comprising SEQ ID NO: 554; a light chain comprising SEQ ID NO: 398 and a heavy chain comprising SEQ ID NO: 555; a light chain comprising SEQ ID NO: 399 and a heavy chain comprising SEQ ID NO: 556; a light chain comprising SEQ ID NO: 400 and a heavy chain comprising SEQ ID NO: 557; a light chain comprising SEQ ID NO: 401 and a heavy chain comprising SEQ ID NO: 558;

a light chain comprising SEQ ID NO: 402 and a heavy chain comprising SEQ ID NO: 559; a light chain comprising SEQ ID NO: 403 and a heavy chain comprising SEQ ID NO: 560; a light chain comprising SEQ ID NO: 404 and a heavy chain comprising SEQ ID NO: 561; a light chain comprising SEQ ID NO: 405 and a heavy chain comprising SEQ ID NO: 562; a light chain comprising SEQ ID NO: 406 and a heavy chain comprising SEQ ID NO: 563; a light chain comprising SEQ ID NO: 407 and a heavy chain comprising SEQ ID NO: 564; a light chain comprising SEQ ID NO: 408 and a heavy chain comprising SEQ ID NO: 565; a light chain comprising SEQ ID NO: 409 and a heavy chain comprising SEQ ID NO: 566; a light chain comprising SEQ ID NO: 410 and a heavy chain comprising SEQ ID NO: 567; a light chain comprising SEQ ID NO: 411 and a heavy chain comprising SEQ ID NO: 568; a light chain comprising SEQ ID NO: 412 and a heavy chain comprising SEQ ID NO: 569; a light chain comprising SEQ ID NO: 413 and a heavy chain comprising SEQ ID NO: 570; a light chain comprising SEQ ID NO: 414 and a heavy chain comprising SEQ ID NO: 571; a light chain comprising SEQ ID NO: 415 and a heavy chain comprising SEQ ID NO: 572; a light chain comprising SEQ ID NO: 416 and a heavy chain comprising SEQ ID NO: 573; a light chain comprising SEQ ID NO: 417 and a heavy chain comprising SEQ ID NO: 574; a light chain comprising SEQ ID NO: 418 and a heavy chain comprising SEQ ID NO: 575; a light chain comprising SEQ ID NO: 419 and a heavy chain comprising SEQ ID NO: 576; a light chain comprising SEQ ID NO: 420 and a heavy chain comprising SEQ ID NO: 577; a light chain comprising SEQ ID NO: 421 and a heavy chain comprising SEQ ID NO: 578; a light chain comprising SEQ ID NO: 422 and a heavy chain comprising SEQ ID NO: 579; a light chain comprising SEQ ID NO: 423 and a heavy chain comprising SEQ ID NO: 580; a light chain comprising SEQ ID NO: 424 and a heavy chain comprising SEQ ID NO: 581; a light chain comprising SEQ ID NO: 425 and a heavy chain comprising SEQ ID NO: 582; a light chain comprising SEQ ID NO: 426 and a heavy chain comprising SEQ ID NO: 583; a light chain comprising SEQ ID NO: 427 and a heavy chain comprising SEQ ID NO: 584; a light chain comprising SEQ ID NO: 428 and a heavy chain comprising SEQ ID NO: 585; a light chain comprising SEQ ID NO: 429 and a heavy chain comprising SEQ ID NO: 586; a light chain comprising SEQ ID NO: 430 and a heavy chain comprising SEQ ID NO: 587; a light chain comprising SEQ ID NO: 431 and a heavy chain comprising SEQ ID NO: 588; a light chain comprising SEQ ID NO: 432 and a heavy chain comprising SEQ ID NO: 589; a light chain comprising SEQ ID NO: 433 and a heavy chain comprising SEQ ID NO: 590; a light chain comprising SEQ ID NO: 434 and a heavy chain comprising SEQ ID NO: 591; a light chain comprising SEQ ID NO: 435 and a heavy chain comprising SEQ ID NO: 592; a light chain comprising SEQ ID NO: 436 and a heavy chain comprising SEQ ID NO: 593; a light chain comprising SEQ ID NO: 437 and a heavy chain comprising SEQ ID NO: 594; a light chain comprising SEQ ID NO: 438 and a heavy chain comprising SEQ ID NO: 595; a light chain comprising SEQ ID NO: 439 and a heavy chain comprising SEQ ID NO: 596; a light chain comprising SEQ ID NO: 440 and a heavy chain comprising SEQ ID NO: 597; a light chain comprising SEQ ID NO: 441 and a heavy chain comprising SEQ ID NO: 598; a light chain comprising SEQ ID NO: 442 and a heavy chain comprising SEQ ID NO: 599; a light chain comprising SEQ ID NO: 443 and a heavy chain comprising SEQ ID NO: 600; a light chain comprising SEQ ID NO: 444 and a heavy chain comprising SEQ ID NO: 601; a light chain comprising SEQ ID NO: 445 and a heavy chain comprising SEQ ID NO: 602; a light chain comprising SEQ ID NO: 446 and a heavy chain comprising SEQ ID NO: 603; a light chain comprising SEQ ID NO: 447 and a heavy chain comprising SEQ ID NO: 604; a light chain comprising SEQ ID NO: 448 and a heavy chain comprising SEQ ID NO: 605; a light chain comprising SEQ ID NO: 449 and a heavy chain comprising SEQ ID NO: 606; a light chain comprising SEQ ID NO: 450 and a heavy chain comprising SEQ ID NO: 607; a light chain comprising SEQ ID NO: 451 and a heavy chain comprising SEQ ID NO: 608; a light chain comprising SEQ ID NO: 452 and a heavy chain comprising SEQ ID NO: 609; a light chain comprising SEQ ID NO: 453 and a heavy chain comprising SEQ ID NO: 610; a light chain comprising SEQ ID NO: 454 and a heavy chain comprising SEQ ID NO: 611; a light chain comprising SEQ ID NO: 455 and a heavy chain comprising SEQ ID NO: 612; a light chain comprising SEQ ID NO: 456 and a heavy chain comprising SEQ ID NO: 613; a light chain comprising SEQ ID NO: 457 and a heavy chain comprising SEQ ID NO: 614; a light chain comprising SEQ ID NO: 458 and a heavy chain comprising SEQ ID NO: 615; a light chain comprising SEQ ID NO: 459 and a heavy chain comprising SEQ ID NO: 616; a light chain comprising SEQ ID NO: 460 and a heavy chain comprising SEQ ID NO: 617; a light chain comprising SEQ ID NO: 461 and a heavy chain comprising SEQ ID NO: 618; a light chain comprising SEQ ID NO: 462 and a heavy chain comprising SEQ ID NO: 619; a light chain comprising SEQ ID NO: 463 and a heavy chain comprising SEQ ID NO: 620; a light chain comprising SEQ ID NO: 464 and a heavy chain comprising SEQ ID NO: 621; a light chain comprising SEQ ID NO: 465 and a heavy chain comprising SEQ ID NO: 622; a light chain comprising SEQ ID NO: 466 and a heavy chain comprising SEQ ID NO: 623; a light chain comprising SEQ ID NO: 467 and a heavy chain comprising SEQ ID NO: 624; a light chain comprising SEQ ID NO: 468 and a heavy chain comprising SEQ ID NO: 625; a light chain comprising SEQ ID NO: 469 and a heavy chain comprising SEQ ID NO: 626; a light chain comprising SEQ ID NO: 470 and a heavy chain comprising SEQ ID NO: 627; and a light chain comprising SEQ ID NO: 471 and a heavy chain comprising SEQ ID NO: 628.

In one embodiment the antibody or fragment thereof comprises a light chain encoded by a polynucleotide sequence selected from the group consisting of SEQ ID NOs: 1885-2014 and a heavy chain comprising a sequence selected from the group consisting of SEQ ID NOs: 2042-2198. In one embodiment the antibody or fragment thereof comprises a combination of a light chain and a heavy chain, selected from the group consisting of a light chain encoded by a polynucleotide sequence comprising SEQ ID NO: 1885 and a heavy chain encoded by a polynucleotide sequence comprising SEQ ID NO: 2042; a light chain encoded by a polynucleotide sequence comprising SEQ ID NO: 1886 and a heavy chain encoded by a polynucleotide sequence comprising SEQ ID NO: 2043; a light chain encoded by a polynucleotide sequence comprising SEQ ID NO: 1887 and a heavy chain encoded by a polynucleotide sequence comprising SEQ ID NO: 2044; a light chain encoded by a polynucleotide sequence comprising SEQ ID NO: 1888 and a heavy chain encoded by a polynucleotide sequence comprising SEQ ID NO: 2045; a light chain encoded by a polynucleotide sequence comprising SEQ ID NO: 1889 and a heavy chain encoded by a polynucleotide sequence comprising SEQ ID NO: 2046; a light chain encoded by a polynucleotide sequence comprising SEQ ID NO: 1890 and a heavy chain encoded by a polynucleotide sequence comprising SEQ ID NO: 2047; a light chain encoded by a polynucleotide sequence comprising SEQ ID NO: 1891 and a heavy chain encoded by a polynucleotide sequence comprising SEQ ID NO: 2048; a light chain encoded by a polynucleotide sequence comprising SEQ ID NO: 1892 and a heavy chain encoded by a polynucleotide sequence comprising SEQ ID NO: 2049; a light chain encoded by a polynucleotide sequence comprising SEQ ID NO: 1893 and a heavy chain encoded by a polynucleotide sequence comprising SEQ ID NO: 2050; a light chain encoded by a polynucleotide sequence comprising SEQ ID NO: 1894 and a heavy chain encoded by a polynucleotide sequence comprising SEQ ID NO: 2051; a light chain encoded by a polynucleotide sequence comprising SEQ ID NO: 1895 and a heavy chain encoded by a polynucleotide sequence comprising SEQ ID NO: 2052; a light chain encoded by a polynucleotide sequence comprising SEQ ID NO: 1896 and a heavy chain encoded by a polynucleotide sequence comprising SEQ ID NO: 2053; a light chain encoded by a polynucleotide sequence comprising SEQ ID NO: 1897 and a heavy chain encoded by a polynucleotide sequence comprising SEQ ID NO: 2054; a light chain encoded by a polynucleotide sequence comprising SEQ ID NO: 1898 and a heavy chain encoded by a polynucleotide sequence comprising SEQ ID NO: 2055; a light chain encoded by a polynucleotide sequence comprising SEQ ID NO: 1899 and a heavy chain encoded by a polynucleotide sequence comprising SEQ ID NO: 2056; a light chain encoded by a polynucleotide sequence comprising SEQ ID NO: 1900 and a heavy chain encoded by a polynucleotide sequence comprising SEQ ID NO: 2057; a light chain encoded by a polynucleotide sequence comprising SEQ ID NO: 1901 and a heavy chain encoded by a polynucleotide sequence comprising SEQ ID NO: 2058; a light chain encoded by a polynucleotide sequence comprising SEQ ID NO: 1902 and a heavy chain encoded by a polynucleotide sequence comprising SEQ ID NO: 2059; a light chain encoded by a polynucleotide sequence comprising SEQ ID NO: 1903 and a heavy chain encoded by a polynucleotide sequence comprising SEQ ID NO: 2060; a light chain encoded by a polynucleotide sequence comprising SEQ ID NO: 1904 and a heavy chain encoded by a polynucleotide sequence comprising SEQ ID NO: 2061; a light chain encoded by a polynucleotide sequence comprising SEQ ID NO: 1905 and a heavy chain encoded by a polynucleotide sequence comprising SEQ ID NO: 2062; a light chain encoded by a polynucleotide sequence comprising SEQ ID NO: 1906 and a heavy chain encoded by a polynucleotide sequence comprising SEQ ID NO: 2063; a light chain encoded by a polynucleotide sequence comprising SEQ ID NO: 1907 and a heavy chain encoded by a polynucleotide sequence comprising SEQ ID NO: 2064; a light chain encoded by a polynucleotide sequence comprising SEQ ID NO: 1908 and a heavy chain encoded by a polynucleotide sequence comprising SEQ ID NO: 2065; a light chain encoded by a polynucleotide sequence comprising SEQ ID NO: 1909 and a heavy chain encoded by a polynucleotide sequence comprising SEQ ID NO: 2066; a light chain encoded by a polynucleotide sequence comprising SEQ ID NO: 1910 and a heavy chain encoded by a polynucleotide sequence comprising SEQ ID NO: 2067; a light chain encoded by a polynucleotide sequence comprising SEQ ID NO: 1911 and a heavy chain encoded by a polynucleotide sequence comprising SEQ ID NO: 2068; a light chain encoded by a polynucleotide sequence comprising SEQ ID NO: 1912 and a heavy chain encoded by a polynucleotide sequence comprising SEQ ID NO: 2069; a light chain encoded by a polynucleotide sequence comprising SEQ ID NO: 1913 and a heavy chain encoded by a polynucleotide sequence comprising SEQ ID NO: 2070; a light chain encoded by a polynucleotide sequence comprising SEQ ID NO: 1914 and a heavy chain encoded by a polynucleotide sequence comprising SEQ ID NO: 2071; a light chain encoded by a polynucleotide sequence comprising SEQ ID NO: 1915 and a heavy chain encoded by a polynucleotide sequence comprising SEQ ID NO: 2072; a light chain encoded by a polynucleotide sequence comprising SEQ ID NO: 1916 and a heavy chain encoded by a polynucleotide sequence comprising SEQ ID NO: 2073; a light chain encoded by a polynucleotide sequence comprising SEQ ID NO: 1917 and a heavy chain encoded by a polynucleotide sequence comprising SEQ ID NO: 2074; a light chain encoded by a polynucleotide sequence comprising SEQ ID NO: 1918 and a heavy chain encoded by a polynucleotide sequence comprising SEQ ID NO: 2075; a light chain encoded by a polynucleotide sequence comprising SEQ ID NO: 1919 and a heavy chain encoded by a polynucleotide sequence comprising SEQ ID NO: 2076; a light chain encoded by a polynucleotide sequence comprising SEQ ID NO: 1920 and a heavy chain encoded by a polynucleotide sequence comprising SEQ ID NO: 2077; a light chain encoded by a polynucleotide sequence comprising SEQ ID NO: 1921 and a heavy chain encoded by a polynucleotide sequence comprising SEQ ID NO: 2078; a light chain encoded by a polynucleotide sequence comprising SEQ ID NO: 1922 and a heavy chain encoded by a polynucleotide sequence comprising SEQ ID NO: 2079; a light chain encoded by a polynucleotide sequence comprising SEQ ID NO: 1923 and a heavy chain encoded by a polynucleotide sequence comprising SEQ ID NO: 2080; a light chain encoded by a polynucleotide sequence comprising SEQ ID NO: 1924 and a heavy chain encoded by a polynucleotide sequence comprising SEQ ID NO: 2081; a light chain encoded by a polynucleotide sequence comprising SEQ ID NO: 1925 and a heavy chain encoded by a polynucleotide sequence comprising SEQ ID NO: 2082; a light chain encoded by a polynucleotide sequence comprising SEQ ID NO: 1926 and a heavy chain encoded by a polynucleotide sequence comprising SEQ ID NO: 2083; a light chain encoded by a polynucleotide sequence comprising SEQ ID NO: 1927 and a heavy chain encoded by a polynucleotide sequence comprising SEQ ID NO: 2084; a light chain encoded by a polynucleotide sequence comprising SEQ ID NO: 1928 and a heavy chain encoded by a polynucleotide sequence comprising SEQ ID NO: 2085; a light chain encoded by a polynucleotide sequence comprising SEQ ID NO: 1929 and a heavy chain encoded by a polynucleotide sequence comprising SEQ ID NO: 2086; a light chain encoded by a polynucleotide sequence comprising SEQ ID NO: 1930 and a heavy chain encoded by a polynucleotide sequence comprising SEQ ID NO: 2087; a light chain encoded by a polynucleotide sequence comprising SEQ ID NO: 1931 and a heavy chain encoded by a polynucleotide sequence comprising SEQ ID NO: 2088; a light chain encoded by a polynucleotide sequence comprising SEQ ID NO: 1932 and a heavy chain encoded by a polynucleotide sequence comprising SEQ ID NO: 2089; a light chain encoded by a polynucleotide sequence comprising SEQ ID NO: 1933 and a heavy chain encoded by a polynucleotide sequence comprising SEQ ID NO: 2090; a light chain encoded by a polynucleotide sequence comprising SEQ ID NO: 1934 and a heavy chain encoded by a polynucleotide sequence comprising SEQ ID NO: 2091; a light chain encoded by a polynucleotide sequence comprising SEQ ID NO: 1935 and a heavy chain encoded by a polynucleotide sequence comprising SEQ ID NO: 2092; a light chain encoded by a polynucleotide sequence comprising SEQ ID NO: 1936 and a heavy chain encoded by a polynucleotide sequence comprising SEQ ID NO: 2093; a light chain encoded by a polynucleotide sequence comprising SEQ ID NO: 1937 and a heavy chain encoded by a polynucleotide sequence comprising SEQ ID NO: 2094; a light chain encoded by a polynucleotide sequence comprising SEQ ID NO: 1938 and a heavy chain encoded by a polynucleotide sequence comprising SEQ ID NO: 2095; a light chain encoded by a polynucleotide sequence comprising SEQ ID NO: 1939 and a heavy chain encoded by a polynucleotide sequence comprising SEQ ID NO: 2096; a light chain encoded by a polynucleotide sequence comprising SEQ ID NO: 1940 and a heavy chain encoded by a polynucleotide sequence comprising SEQ ID NO: 2097; a light chain encoded by a polynucleotide sequence comprising SEQ ID NO: 1941 and a heavy chain encoded by a polynucleotide sequence comprising SEQ ID NO: 2098; a light chain encoded by a polynucleotide sequence comprising SEQ ID NO: 1942 and a heavy chain encoded by a polynucleotide sequence comprising SEQ ID NO: 2099; a light chain encoded by a polynucleotide sequence comprising SEQ ID NO: 1943 and a heavy chain encoded by a polynucleotide sequence comprising SEQ ID NO: 2100; a light chain encoded by a polynucleotide sequence comprising SEQ ID NO: 1944 and a heavy chain encoded by a polynucleotide sequence comprising SEQ ID NO: 2101; a light chain encoded by a polynucleotide sequence comprising SEQ ID NO: 1945 and a heavy chain encoded by a polynucleotide sequence comprising SEQ ID NO: 2102; a light chain encoded by a polynucleotide sequence comprising SEQ ID NO: 1946 and a heavy chain encoded by a polynucleotide sequence comprising SEQ ID NO: 2103; a light chain encoded by a polynucleotide sequence comprising SEQ ID NO: 1947 and a heavy chain encoded by a polynucleotide sequence comprising SEQ ID NO: 2104; a light chain encoded by a polynucleotide sequence comprising SEQ ID NO: 1948 and a heavy chain encoded by a polynucleotide sequence comprising SEQ ID NO: 2105; a light chain encoded by a polynucleotide sequence comprising SEQ ID NO: 1949 and a heavy chain encoded by a polynucleotide sequence comprising SEQ ID NO: 2106; a light chain encoded by a polynucleotide sequence comprising SEQ ID NO: 1950 and a heavy chain encoded by a polynucleotide sequence comprising SEQ ID NO: 2107; a light chain encoded by a polynucleotide sequence comprising SEQ ID NO: 1951 and a heavy chain encoded by a polynucleotide sequence comprising SEQ ID NO: 2108; a light chain encoded by a polynucleotide sequence comprising SEQ ID NO: 1952 and a heavy chain encoded by a polynucleotide sequence comprising SEQ ID NO: 2109; a light chain encoded by a polynucleotide sequence comprising SEQ ID NO: 1953 and a heavy chain encoded by a polynucleotide sequence comprising SEQ ID NO: 2110; a light chain encoded by a polynucleotide sequence comprising SEQ ID NO: 1954 and a heavy chain encoded by a polynucleotide sequence comprising SEQ ID NO: 2111; a light chain encoded by a polynucleotide sequence comprising SEQ ID NO: 1955 and a heavy chain encoded by a polynucleotide sequence comprising SEQ ID NO: 2112; a light chain encoded by a polynucleotide sequence comprising SEQ ID NO: 1956 and a heavy chain encoded by a polynucleotide sequence comprising SEQ ID NO: 2113; a light chain encoded by a polynucleotide sequence comprising SEQ ID NO: 1957 and a heavy chain encoded by a polynucleotide sequence comprising SEQ ID NO: 2114; a light chain encoded by a polynucleotide sequence comprising SEQ ID NO: 1958 and a heavy chain encoded by a polynucleotide sequence comprising SEQ ID NO: 2115; a light chain encoded by a polynucleotide sequence comprising SEQ ID NO: 1959 and a heavy chain encoded by a polynucleotide sequence comprising SEQ ID NO: 2116; a light chain encoded by a polynucleotide sequence comprising SEQ ID NO: 1960 and a heavy chain encoded by a polynucleotide sequence comprising SEQ ID NO: 2117; a light chain encoded by a polynucleotide sequence comprising SEQ ID NO: 1961 and a heavy chain encoded by a polynucleotide sequence comprising SEQ ID NO: 2118; a light chain encoded by a polynucleotide sequence comprising SEQ ID NO: 1962 and a heavy chain encoded by a polynucleotide sequence comprising SEQ ID NO: 2119; a light chain encoded by a polynucleotide sequence comprising SEQ ID NO: 1963 and a heavy chain encoded by a polynucleotide sequence comprising SEQ ID NO: 2120; a light chain encoded by a polynucleotide sequence comprising SEQ ID NO: 1964 and a heavy chain encoded by a polynucleotide sequence comprising SEQ ID NO: 2121; a light chain encoded by a polynucleotide sequence comprising SEQ ID NO: 1965 and a heavy chain encoded by a polynucleotide sequence comprising SEQ ID NO: 2122; a light chain encoded by a polynucleotide sequence comprising SEQ ID NO: 1966 and a heavy chain encoded by a polynucleotide sequence comprising SEQ ID NO: 2123; a light chain encoded by a polynucleotide sequence comprising SEQ ID NO: 1967 and a heavy chain encoded by a polynucleotide sequence comprising SEQ ID NO: 2124; a light chain encoded by a polynucleotide sequence comprising SEQ ID NO: 1968 and a heavy chain encoded by a polynucleotide sequence comprising SEQ ID NO: 2125; a light chain encoded by a polynucleotide sequence comprising SEQ ID NO: 1969 and a heavy chain encoded by a polynucleotide sequence comprising SEQ ID NO: 2126; a light chain encoded by a polynucleotide sequence comprising SEQ ID NO: 1970 and a heavy chain encoded by a polynucleotide sequence comprising SEQ ID NO: 2127; a light chain encoded by a polynucleotide sequence comprising SEQ ID NO: 1971 and a heavy chain encoded by a polynucleotide sequence comprising SEQ ID NO: 2128; a light chain encoded by a polynucleotide sequence comprising SEQ ID NO: 1972 and a heavy chain encoded by a polynucleotide sequence comprising SEQ ID NO: 2129; a light chain encoded by a polynucleotide sequence comprising SEQ ID NO: 1973 and a heavy chain encoded by a polynucleotide sequence comprising SEQ ID NO: 2130; a light chain encoded by a polynucleotide sequence comprising SEQ ID NO: 1974 and a heavy chain encoded by a polynucleotide sequence comprising SEQ ID NO: 2131; a light chain encoded by a polynucleotide sequence comprising SEQ ID NO: 1975 and a heavy chain encoded by a polynucleotide sequence comprising SEQ ID NO: 2132; a light chain encoded by a polynucleotide sequence comprising SEQ ID NO: 1976 and a heavy chain encoded by a polynucleotide sequence comprising SEQ ID NO: 2133; a light chain encoded by a polynucleotide sequence comprising SEQ ID NO: 1977 and a heavy chain encoded by a polynucleotide sequence comprising SEQ ID NO: 2134; a light chain encoded by a polynucleotide sequence comprising SEQ ID NO: 1978 and a heavy chain encoded by a polynucleotide sequence comprising SEQ ID NO: 2135; a light chain encoded by a polynucleotide sequence comprising SEQ ID NO: 1979 and a heavy chain encoded by a polynucleotide sequence comprising SEQ ID NO: 2136; a light chain encoded by a polynucleotide sequence comprising SEQ ID NO: 1980 and a heavy chain encoded by a polynucleotide sequence comprising SEQ ID NO: 2137; a light chain encoded by a polynucleotide sequence comprising SEQ ID NO: 1981 and a heavy chain encoded by a polynucleotide sequence comprising SEQ ID NO: 2138; a light chain encoded by a polynucleotide sequence comprising SEQ ID NO: 1982 and a heavy chain encoded by a polynucleotide sequence comprising SEQ ID NO: 2139; a light chain encoded by a polynucleotide sequence comprising SEQ ID NO: 1983 and a heavy chain encoded by a polynucleotide sequence comprising SEQ ID NO: 2140; a light chain encoded by a polynucleotide sequence comprising SEQ ID NO: 1984 and a heavy chain encoded by a polynucleotide sequence comprising SEQ ID NO: 2141; a light chain encoded by a polynucleotide sequence comprising SEQ ID NO: 1985 and a heavy chain encoded by a polynucleotide sequence comprising SEQ ID NO: 2142; a light chain encoded by a polynucleotide sequence comprising SEQ ID NO: 1986 and a heavy chain encoded by a polynucleotide sequence comprising SEQ ID NO: 2143; a light chain encoded by a polynucleotide sequence comprising SEQ ID NO: 1987 and a heavy chain encoded by a polynucleotide sequence comprising SEQ ID NO: 2144; a light chain encoded by a polynucleotide sequence comprising SEQ ID NO: 1988 and a heavy chain encoded by a polynucleotide sequence comprising SEQ ID NO: 2145; a light chain encoded by a polynucleotide sequence comprising SEQ ID NO: 1989 and a heavy chain encoded by a polynucleotide sequence comprising SEQ ID NO: 2146; a light chain encoded by a polynucleotide sequence comprising SEQ ID NO: 1990 and a heavy chain encoded by a polynucleotide sequence comprising SEQ ID NO: 2147; a light chain encoded by a polynucleotide sequence comprising SEQ ID NO: 1991 and a heavy chain encoded by a polynucleotide sequence comprising SEQ ID NO: 2148; a light chain encoded by a polynucleotide sequence comprising SEQ ID NO: 1992 and a heavy chain encoded by a polynucleotide sequence comprising SEQ ID NO: 2149; a light chain encoded by a polynucleotide sequence comprising SEQ ID NO: 1993 and a heavy chain encoded by a polynucleotide sequence comprising SEQ ID NO: 2150; a light chain encoded by a polynucleotide sequence comprising SEQ ID NO: 1994 and a heavy chain encoded by a polynucleotide sequence comprising SEQ ID NO: 2151; a light chain encoded by a polynucleotide sequence comprising SEQ ID NO: 1995 and a heavy chain encoded by a polynucleotide sequence comprising SEQ ID NO: 2152; a light chain encoded by a polynucleotide sequence comprising SEQ ID NO: 1996 and a heavy chain encoded by a polynucleotide sequence comprising SEQ ID NO: 2153; a light chain encoded by a polynucleotide sequence comprising SEQ ID NO: 1997 and a heavy chain encoded by a polynucleotide sequence comprising SEQ ID NO: 2154; a light chain encoded by a polynucleotide sequence comprising SEQ ID NO: 1998 and a heavy chain encoded by a polynucleotide sequence comprising SEQ ID NO: 2155; a light chain encoded by a polynucleotide sequence comprising SEQ ID NO: 1999 and a heavy chain encoded by a polynucleotide sequence comprising SEQ ID NO: 2156; a light chain encoded by a polynucleotide sequence comprising SEQ ID NO: 2000 and a heavy chain encoded by a polynucleotide sequence comprising SEQ ID NO: 2157; a light chain encoded by a polynucleotide sequence comprising SEQ ID NO: 2001 and a heavy chain encoded by a polynucleotide sequence comprising SEQ ID NO: 2158; a light chain encoded by a polynucleotide sequence comprising SEQ ID NO: 2002 and a heavy chain encoded by a polynucleotide sequence comprising SEQ ID NO: 2159; a light chain encoded by a polynucleotide sequence comprising SEQ ID NO: 2003 and a heavy chain encoded by a polynucleotide sequence comprising SEQ ID NO: 2160; a light chain encoded by a polynucleotide sequence comprising SEQ ID NO: 2004 and a heavy chain encoded by a polynucleotide sequence comprising SEQ ID NO: 2161; a light chain encoded by a polynucleotide sequence comprising SEQ ID NO: 2005 and a heavy chain encoded by a polynucleotide sequence comprising SEQ ID NO: 2162; a light chain encoded by a polynucleotide sequence comprising SEQ ID NO: 2006 and a heavy chain encoded by a polynucleotide sequence comprising SEQ ID NO: 2163; a light chain encoded by a polynucleotide sequence comprising SEQ ID NO: 2007 and a heavy chain encoded by a polynucleotide sequence comprising SEQ ID NO: 2164; a light chain encoded by a polynucleotide sequence comprising SEQ ID NO: 2008 and a heavy chain encoded by a polynucleotide sequence comprising SEQ ID NO: 2165; a light chain encoded by a polynucleotide sequence comprising SEQ ID NO: 2009 and a heavy chain encoded by a polynucleotide sequence comprising SEQ ID NO: 2166; a light chain encoded by a polynucleotide sequence comprising SEQ ID NO: 2010 and a heavy chain encoded by a polynucleotide sequence comprising SEQ ID NO: 2167; a light chain encoded by a polynucleotide sequence comprising SEQ ID NO: 2011 and a heavy chain encoded by a polynucleotide sequence comprising SEQ ID NO: 2168; a light chain encoded by a polynucleotide sequence comprising SEQ ID NO: 2012 and a heavy chain encoded by a polynucleotide sequence comprising SEQ ID NO: 2169; a light chain encoded by a polynucleotide sequence comprising SEQ ID NO: 2013 and a heavy chain encoded by a polynucleotide sequence comprising SEQ ID NO: 2170; a light chain encoded by a polynucleotide sequence comprising SEQ ID NO: 2014 and a heavy chain encoded by a polynucleotide sequence comprising SEQ ID NO: 2171; a light chain encoded by a polynucleotide sequence comprising SEQ ID NO: 2015 and a heavy chain encoded by a polynucleotide sequence comprising SEQ ID NO: 2172; a light chain encoded by a polynucleotide sequence comprising SEQ ID NO: 2016 and a heavy chain encoded by a polynucleotide sequence comprising SEQ ID NO: 2173; a light chain encoded by a polynucleotide sequence comprising SEQ ID NO: 2017 and a heavy chain encoded by a polynucleotide sequence comprising SEQ ID NO: 2174; a light chain encoded by a polynucleotide sequence comprising SEQ ID NO: 2018 and a heavy chain encoded by a polynucleotide sequence comprising SEQ ID NO: 2175; a light chain encoded by a polynucleotide sequence comprising SEQ ID NO: 2019 and a heavy chain encoded by a polynucleotide sequence comprising SEQ ID NO: 2176; a light chain encoded by a polynucleotide sequence comprising SEQ ID NO: 2020 and a heavy chain encoded by a polynucleotide sequence comprising SEQ ID NO: 2177; a light chain encoded by a polynucleotide sequence comprising SEQ ID NO: 2021 and a heavy chain encoded by a polynucleotide sequence comprising SEQ ID NO: 2178; a light chain encoded by a polynucleotide sequence comprising SEQ ID NO: 2022 and a heavy chain encoded by a polynucleotide sequence comprising SEQ ID NO: 2179; a light chain encoded by a polynucleotide sequence comprising SEQ ID NO: 2023 and a heavy chain encoded by a polynucleotide sequence comprising SEQ ID NO: 2180; a light chain encoded by a polynucleotide sequence comprising SEQ ID NO: 2024 and a heavy chain encoded by a polynucleotide sequence comprising SEQ ID NO: 2181; a light chain encoded by a polynucleotide sequence comprising SEQ ID NO: 2025 and a heavy chain encoded by a polynucleotide sequence comprising SEQ ID NO: 2182; a light chain encoded by a polynucleotide sequence comprising SEQ ID NO: 2026 and a heavy chain encoded by a polynucleotide sequence comprising SEQ ID NO: 2183; a light chain encoded by a polynucleotide sequence comprising SEQ ID NO: 2027 and a heavy chain encoded by a polynucleotide sequence comprising SEQ ID NO: 2184; a light chain encoded by a polynucleotide sequence comprising SEQ ID NO: 2028 and a heavy chain encoded by a polynucleotide sequence comprising SEQ ID NO: 2185; a light chain encoded by a polynucleotide sequence comprising SEQ ID NO: 2029 and a heavy chain encoded by a polynucleotide sequence comprising SEQ ID NO: 2186; a light chain encoded by a polynucleotide sequence comprising SEQ ID NO: 2030 and a heavy chain encoded by a polynucleotide sequence comprising SEQ ID NO: 2187; a light chain encoded by a polynucleotide sequence comprising SEQ ID NO: 2031 and a heavy chain encoded by a polynucleotide sequence comprising SEQ ID NO: 2188; a light chain encoded by a polynucleotide sequence comprising SEQ ID NO: 2032 and a heavy chain encoded by a polynucleotide sequence comprising SEQ ID NO: 2189; a light chain encoded by a polynucleotide sequence comprising SEQ ID NO: 2033 and a heavy chain encoded by a polynucleotide sequence comprising SEQ ID NO: 2190; a light chain encoded by a polynucleotide sequence comprising SEQ ID NO: 2034 and a heavy chain encoded by a polynucleotide sequence comprising SEQ ID NO: 2191; a light chain encoded by a polynucleotide sequence comprising SEQ ID NO: 2035 and a heavy chain encoded by a polynucleotide sequence comprising SEQ ID NO: 2192; a light chain encoded by a polynucleotide sequence comprising SEQ ID NO: 2036 and a heavy chain encoded by a polynucleotide sequence comprising SEQ ID NO: 2193; a light chain encoded by a polynucleotide sequence comprising SEQ ID NO: 2037 and a heavy chain encoded by a polynucleotide sequence comprising SEQ ID NO: 2194; a light chain encoded by a polynucleotide sequence comprising SEQ ID NO: 2038 and a heavy chain encoded by a polynucleotide sequence comprising SEQ ID NO: 2195; a light chain encoded by a polynucleotide sequence comprising SEQ ID NO: 2039 and a heavy chain encoded by a polynucleotide sequence comprising SEQ ID NO: 2196; a light chain encoded by a polynucleotide sequence comprising SEQ ID NO: 2040 and a heavy chain encoded by a polynucleotide sequence comprising SEQ ID NO: 2197; and a light chain encoded by a polynucleotide sequence comprising SEQ ID NO: 2041 and a heavy chain encoded by a polynucleotide sequence comprising SEQ ID NO: 2198.

In another aspect, the antigen binding protein comprises a full length light chain and a full length heavy chain as listed in one of the rows for one of the antibodies listed in TABLE 5. Some antigen binding proteins that are provided comprise a full length light chain and a full length heavy chain as listed in one of the rows for one of the antibodies listed in TABLE 5, except that one or both of the chains differs from the sequence specified in the table at only 1, 2, 3, 4, 5, 6, 7, 8, 9, 10, 11, 12, 13, 14 or 15 amino acid residues, wherein each such sequence difference is independently either a single amino acid deletion, insertion or substitution, with the deletions, insertions and/or substitutions resulting in no more than 1, 2, 3, 4, 5, 6, 7, 8, 9, 10, 11, 12, 13, 14 or 15 amino acid changes relative to the full length sequences specified in TABLE 5. In one embodiment the antigen binding protein comprises a full length light chain and/or a full length heavy chain from Table 5 with the N-terminal methionine deleted. In one embodiment the antigen binding protein comprises a full length light chain and/or a full length heavy chain from Table 5 with the C-terminal lysine deleted. Other antigen binding proteins also comprise a full length light chain and a full length heavy chain as listed in one of the rows for one of the antibodies listed in TABLE 5, except that one or both of the chains differs from the sequence specified in the table in that the light chain and/or heavy chain comprises or consists of a sequence of amino acids that has at least 70%, 75%, 80%, 85%, 90%, 95%, 96%, 97%, 98%, or 99% sequence identity to the amino acid sequences of the light chain or heavy chain sequences as specified in TABLE 5.

In another embodiment, the antigen binding protein consists of a just a light or a heavy chain polypeptide as set forth in TABLE 5.

In still another aspect, antigen-binding proteins containing the CDRs, variable domains and/or full length sequences listed in TABLES 3, 4A, 4B, and 5 is a monoclonal antibody, a chimeric antibody, a humanized antibody, a human antibody, a multispecific antibody, or an antibody fragment of the foregoing. In another embodiment, the antibody fragment of the isolated antigen-binding proteins provided herein is a Fab fragment, a Fab' fragment, an $F(ab')_2$ fragment, an Fv fragment, a diabody, or a scFv based upon an antibody with the sequences as listed in TABLE 5.

In yet another aspect, the isolated antigen-binding protein provided in TABLE 5 can be coupled to a labeling group and can compete for binding to GIPR with an antigen binding protein of one of the isolated antigen-binding proteins provided herein.

In another embodiment, antigen binding proteins are provided that compete with one of the exemplified antibodies or functional fragments described above for specific binding to a human GIPR (e.g., SEQ ID NO: 3141). Such antigen binding proteins may bind to the same epitope as one of the antigen binding proteins described herein, or to an overlapping epitope.

Antigen binding proteins and fragments that compete with the exemplified antigen binding proteins are expected to show similar functional properties. The exemplified antigen binding proteins and fragments include those described above, including those with heavy and light chains, variable region domains and CDRs included in TABLES 3, 4A, 4B, and 5. Thus, as a specific example, the antigen binding proteins that are provided include those that compete with an antibody having:

all 6 of the CDRs listed for any antibody listed in TABLES 4A and 4B:

a VH and a VL listed for any antibody listed in TABLE 3: or two light chains and two heavy chains as specified for any antibody listed in TABLE 5.

The antigen binding proteins that are provided include monoclonal antibodies that bind to GIPR. Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-

Ag14, FO, NSO/U, MPC-11, MPC11-X45-GTG 1.7 and S194/5XXO Bul: examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a GIPR immunogen; harvesting spleen cells from the immunized animal: fusing the harvested spleen cells to a myeloma cell line, thereby generating hybridoma cells: establishing hybridoma cell lines from the hybridoma cells, and identifying a hybridoma cell line that produces an antibody that binds a GIPR polypeptide. Such hybridoma cell lines, and anti-GIPR monoclonal antibodies produced by them, are aspects of the present application.

Monoclonal antibodies secreted by a hybridoma cell line can be purified using any technique known in the art. Hybridomas or mAbs may be further screened to identify mAbs with particular properties, such as the ability to increase GIPR activity.

Chimeric and humanized antibodies based upon the foregoing sequences are also provided. Monoclonal antibodies for use as therapeutic agents may be modified in various ways prior to use. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., 1985, *Proc. Natl. Acad. Sci. USA* 81:6851-6855, which are hereby incorporated by reference. CDR grafting is described, for example, in U.S. Pat. No. 6,180,370, 5,693,762, 5,693,761, 5,585,089, and 5,530,101.

Generally, the goal of making a chimeric antibody is to create a chimera in which the number of amino acids from the intended patient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. No. 5,585,089, and 5,693,762; Jones et al., 1986, Nature 321:522-525; Riechmann et al., 1988, Nature 332:323-27: Verhoeven et al., 1988, Science 239: 1534-1536).

In one aspect, the CDRs of the light and heavy chain variable regions of the antibodies provided herein are grafted to framework regions (FRs) from antibodies from the same, or a different, phylogenetic species. For example, the CDRs of the heavy and light chain variable regions $V_H1$, $V_H2$, $V_H3$, $V_H4$, $V_H5$, $V_H6$, $V_H7$, $V_H8$, $V_H9$, $V_H10$, $V_H11$, $V_H12$ and/or VL1, and VL2 can be grafted to consensus human FRs. To create consensus human FRs, FRs from several human heavy chain or light chain amino acid sequences may be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of GIPR antibodies are not replaced, while the rest of the FR amino acids are replaced. A "rare amino acid" is a specific amino acid that is in a position in which this particular amino acid is not usually found in an FR. Alternatively, the grafted variable regions from the one heavy or light chain may be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

Fully human GIPR antibodies are also provided. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents. Fully human antibodies can be produced by immunizing transgenic animals (usually mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., 1993, *Proc. Natl. Acad. Sci. USA* 90:2551-2555: Jakobovits et al., 1993, *Nature* 362:255-258; and Bruggermann et al., 1993, *Year in Immunol.* 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, for example, WO96/

33735 and WO94/02602. Additional methods relating to transgenic mice for making human antibodies are described in U.S. Pat. No. 5,545,807; 6,713,610; 6,673,986; 6,162, 963; 5,545,807; 6,300, 129; 6,255,458; 5,877,397; 5,874, 299 and 5,545,806; in PCT publications WO91/10741, WO90/04036, and in EP 546073B1 and EP 546073A1.

The transgenic mice described above, referred to herein as "HuMab" mice, contain a human immunoglobulin gene minilocus that encodes unrearranged human heavy ([mu] and [gamma]) and [kappa] light chain immunoglobulin sequences, together with targeted mutations that inactivate the endogenous [mu] and [kappa] chain loci (Lonberg et al., 1994, *Nature* 368:856-859). Accordingly, the mice exhibit reduced expression of mouse IgM or [kappa] and in response to immunization, and the introduced human heavy and light chain transgenes undergo class switching and somatic mutation to generate high affinity human IgG [kappa] monoclonal antibodies (Lonberg et al., supra.: Lonberg and Huszar, 1995, *Intern. Rev. Immunol.* 13:65-93: Harding and Lonberg, 1995, *Ann. N.Y Acad. Sci.* 764:536-546). The preparation of HuMab mice is described in detail in Taylor et al., 1992, *Nucleic Acids Research* 20:6287-6295: Chen et al., 1993, *International Immunology* 5:647-656; Tuaillon et al., 1994, *J. Immunol.* 152:2912-2920; Lonberg et al., 1994, *Nature* 368:856-859: Lonberg, 1994, *Handbook of Exp. Pharmacology* 113:49-101: Taylor et al., 1994, *International Immunology* 6:579-591: Lonberg and Huszar, 1995, *Intern. Rev. Immunol.* 13:65-93; Harding and Lonberg, 1995, *Ann. N.Y Acad. Sci.* 764:536-546; Fishwild et al., 1996, *Nature Biotechnology* 14:845-851: the foregoing references are hereby incorporated by reference in their entirety for all purposes. See, further U.S. Pat. No. 5,545,806; 5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227: WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., 1997, *Nature Genetics* 15:146-156, which are hereby incorporated by reference. For example, the HCo7 and HCo12 transgenic mice strains can be used to generate human monoclonal antibodies against GIPR. Further details regarding the production of human antibodies using transgenic mice are provided below.

Using hybridoma technology, antigen-specific human mAbs with the desired specificity can be produced and selected from the transgenic mice such as those described above. Such antibodies may be cloned and expressed using a suitable vector and host cell, or the antibodies can be harvested from cultured hybridoma cells.

Fully human antibodies can also be derived from phage-display libraries (as disclosed in Hoogenboom et al., 1991, *J. Mol. Biol.* 227:381; and Marks et al., 1991, *J. Mol. Biol.* 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference).

The GIPR binding protein can also be a variant, mimetic, derivative or oligomer based upon the structure of GIPR antigen binding proteins have the CDRs, variable regions and/or full length chains as described above.

In one embodiment, for instance, an antigen binding protein is a variant form of the antigen binding proteins disclosed above. For instance, some of the antigen binding proteins have one or more conservative amino acid substitutions in one or more of the heavy or light chains, variable regions or CDRs.

Naturally-occurring amino acids may be divided into classes based on common side chain properties:

1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of the above classes for a member from another class. Such substituted residues may be introduced into regions of the antibody that are homologous with human antibodies, or into the non-homologous regions of the molecule.

In making such changes, according to certain embodiments, the hydropathic index of amino acids may be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are; isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.01); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one may also identify epitopes from primary amino acid sequences on the basis of hydrophilicity. These regions are also referred to as "epitopic core regions."

Exemplary conservative amino acid substitutions are set forth in Table 6.

TABLE 8

Conservative Amino Acid Substitutions

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

A skilled artisan will be able to determine suitable variants of polypeptides as set forth herein using well-known techniques. One skilled in the art may identify suitable areas of the molecule that may be changed without destroying activity by targeting regions not believed to be important for activity. The skilled artisan also will be able to identify residues and portions of the molecules that are conserved among similar polypeptides. In further embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues important for activity or structure in similar proteins. One skilled in the art may opt for chemically similar amino acid substitutions for such predicted important amino acid residues.

One skilled in the art can also analyze the 3-dimensional structure and amino acid sequence in relation to that structure in similar polypeptides. In view of such information, one skilled in the art may predict the alignment of amino acid residues of an antibody with respect to its three dimensional structure. One skilled in the art may choose not to make radical changes to amino acid residues predicted to be on the surface of the protein, since such residues may be involved in important interactions with other molecules. Moreover, one skilled in the art may generate test variants containing a single amino acid substitution at each desired amino acid residue. These variants can then be screened using assays for GIPR activity, thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, 1996, *Curr. Op. in Biotech.* 7:422-427; Chou et al., 1974, *Biochem.* 13:222-245: Chou et al., 1974, *Biochemistry* 113:211-222; Chou et al., 1978, *Adv. Enzymol. Relat. Areas Mol. Biol.* 47:45-148; Chou et al., 1979, *Ann. Rev. Biochem.* 47:251-276; and Chou et al., 1979, *Biophys. J.* 26:367-384. Moreover, computer programs are currently available to assist with predicting secondary structure. One method of predicting secondary structure is based upon homology modeling. For example, two polypeptides or proteins that have a sequence identity of greater than 30%, or similarity greater than 40% can have similar structural topologies. The recent growth of the protein structural database (PDB) has provided enhanced predictability of secondary structure, including the potential number of folds within a polypeptide's or protein's structure. See, Holm et al., 1999, *Nucl. Acid. Res.* 27:244-247. It has been suggested (Brenner et al., 1997, *Curr. Op. Struct. Biol.* 7:369-376) that there are a limited number of folds in a given polypeptide or protein and that once a critical number of structures have been resolved, structural prediction will become dramatically more accurate.

Additional methods of predicting secondary structure include "threading" (Jones, 1997, *Curr. Opin. Struct. Biol.* 7:377-387: Sippl et al., 1996, *Structure* 4:15-19), "profile analysis" (Bowie et al., 1991, *Science* 253:164-170; Gribskov et al., 1990, *Meth. Enzym.* 183:146-159; Gribskov et al., 1987, *Proc. Nat. Acad. Sci.* 84:4355-4358), and "evolutionary linkage" (See, Holm, 1999, supra; and Brenner, 1997, supra).

In some embodiments, amino acid substitutions are made that: (1) reduce susceptibility to proteolysis, (2) reduce susceptibility to oxidation, (3) alter binding affinity for forming protein complexes. (4) alter ligand or antigen binding affinities, and/or (4) confer or modify other physicochemical or functional properties on such polypeptides. For example, single or multiple amino acid substitutions (in certain embodiments, conservative amino acid substitutions) may be made in the naturally-occurring sequence. Substitutions can be made in that portion of the antibody that lies outside the domain(s) forming intermolecular contacts). In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in Proteins, Structures and Molecular Principles (Creighton, Ed.), 1984, W. H. New York: Freeman and Company: Introduction to Protein Structure (Branden and Tooze, eds.), 1991, New York: Garland Publishing; and Thornton et al., 1991, *Nature* 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants may have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind to GIPR. For example, one or more of the CDRs can be incorporated into a molecule (e.g., a polypeptide) covalently or noncovalently to make an immunoadhesion. An immunoadhesion may incorporate the CDR(s) as part of a larger polypeptide chain, may covalently link the CDR(s) to another polypeptide chain, or may incorporate the CDR(s) noncovalently. The CDR(s) enable the immunoadhesion to bind specifically to a particular antigen of interest (e.g., an GIPR polypeptide or epitope thereof).

Derivatives of the antigen binding proteins that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold) bead), or a molecule that binds to another molecule (e.g., biotin or streptavidin)), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a pegylated single chain polypeptide as described herein. In one embodiment, the antigen binding protein is conjugated or otherwise linked to transthyretin (TTR) or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

In some embodiments, the antigen binding protein comprises one or more labels. The term "labeling group" or "label" means any detectable label. Examples of suitable labeling groups include, but are not limited to, the following: radioisotopes or radionuclides (e.g., $^{3}$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used as is seen fit.

The term "effector group" means any group coupled to an antigen binding protein that acts as a cytotoxic agent. Examples for suitable effector groups are radioisotopes or radionuclides (e.g., $^{3}$H, $^{14}$C, $^{15}$N, $^{35}$S, $^{90}$Y, $^{99}$Tc, $^{111}$In, $^{125}$I, $^{131}$I). Other suitable groups include toxins, therapeutic groups, or chemotherapeutic groups. Examples of suitable groups include calicheamicin, auristatins, geldanamycin and maytansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a *Renilla*, Ptilosarcus, or *Aequorea* species of GFP (Chalfie et al., 1994, *Science* 263:802-805), EGFP (Clontech Labs., Inc., Genbank Accession Number U55762), blue fluorescent protein (BFP, Quantum Biotechnologies, Inc., Quebec, Canada; Stauber, 1998, *Biotechniques* 24:462-471: Heim et al., 1996, *Curr. Biol.* 6:178-182), enhanced yellow fluorescent protein (EYFP, Clontech Labs., Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. No. 5,292,658, No. 5418155, No. 5683888, No. 5741668, No. 5777079, No. 5804387, No. 5874304, No. 5876995, No. 5925558).

Nucleic acids that encode for the antigen binding proteins described herein, or portions thereof, are also provided, including nucleic acids encoding one or both chains of an antibody, or a fragment, derivative, mutein, or variant thereof, polynucleotides encoding heavy chain variable regions or only CDRs, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids). Any variable region provided herein may be attached to these constant regions to form complete heavy and light chain sequences. However, it should be understood that these constant regions sequences are provided as specific examples only. In some embodiments, the variable region sequences are joined to other constant region sequences that are known in the art.

Nucleic acids encoding certain antigen binding proteins, or portions thereof (e.g., full length antibody, heavy or light chain, variable domain, or CDRH1, CDRH2, CDRH3, CDRL1, CDRL2, or CDRL3) may be isolated from B-cells of mice that have been immunized with GIPR or an immunogenic fragment thereof. The nucleic acid may be isolated by conventional procedures such as polymerase chain reaction (PCR). Phage display is another example of a known technique whereby derivatives of antibodies and other antigen binding proteins may be prepared. In one approach, polypeptides that are components of an antigen binding protein of interest are expressed in any suitable recombinant expression system, and the expressed polypeptides are allowed to assemble to form antigen binding proteins.

An aspect further provides nucleic acids that hybridize to other nucleic acids under particular hybridization conditions. Methods for hybridizing nucleic acids are well-known in the art. See, e.g., Current Protocols in Molecular Biology, John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65%, 70%, 75%, 80%, 85%, 90%, 95%, 98% or 99% identical to each other typically remain hybridized to each other.

The basic parameters affecting the choice of hybridization conditions and guidance for devising suitable conditions are set forth by, for example, Sambrook, Fritsch, and Maniatis (2001, Molecular Cloning: A Laboratory Manual, Cold Spring Harbor Laboratory Press, Cold Spring Harbor, N.Y., supra; and Current Protocols in Molecular Biology, 1995, Ausubel et al., eds., John Wiley & Sons, Inc., sections 2.10 and 6.3-6.4), and can be readily determined by those having ordinary skill in the art based on, e.g., the length and/or base composition of the nucleic acid.

Changes can be introduced by mutation into a nucleic acid, thereby leading to changes in the amino acid sequence of a polypeptide (e.g., an antibody or antibody derivative) that it encodes. Mutations can be introduced using any technique known in the art. In one embodiment, one or more particular amino acid residues are changed using, for example, a site-directed mutagenesis protocol. In another embodiment, one or more randomly selected residues is changed using, for example, a random mutagenesis protocol. However it is made, a mutant polypeptide can be expressed and screened for a desired property.

Mutations can be introduced into a nucleic acid without significantly altering the biological activity of a polypeptide that it encodes. For example, one can make nucleotide substitutions leading to amino acid substitutions at non-essential amino acid residues. Alternatively, one or more mutations can be introduced into a nucleic acid that selectively changes the biological activity of a polypeptide that it encodes. For example, the mutation can quantitatively or qualitatively change the biological activity. Examples of quantitative changes include increasing, reducing or eliminating the activity. Examples of qualitative changes include changing the antigen specificity of an antibody. In one embodiment, a nucleic acid encoding any antigen binding protein described herein can be mutated to alter the amino acid sequence using molecular biology techniques that are well-established in the art.

Another aspect provides nucleic acid molecules that are suitable for use as primers or hybridization probes for the detection of nucleic acid sequences. A nucleic acid molecule can comprise only a portion of a nucleic acid sequence encoding a full-length polypeptide, for example, a fragment that can be used as a probe or primer or a fragment encoding an active portion of a polypeptide.

Probes based on the sequence of a nucleic acid can be used to detect the nucleic acid or similar nucleic acids, for example, transcripts encoding a polypeptide. The probe can comprise a label group, e.g., a radioisotope, a fluorescent compound, an enzyme, or an enzyme co-factor. Such probes can be used to identify a cell that expresses the polypeptide.

Another aspect provides vectors comprising a nucleic acid encoding a polypeptide or a portion thereof (e.g., a fragment containing one or more CDRs or one or more variable region domains). Examples of vectors include, but are not limited to, plasmids, viral vectors, non-episomal mammalian vectors and expression vectors, for example, recombinant expression vectors. The recombinant expression vectors can comprise a nucleic acid in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see. Voss et al., 1986, *Trends Biochem. Sci.* 11:287, Maniatis et al., 1987, *Science* 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see, id.). It will be appreciated by those skilled in the art that the design of the expression vector can depend on such factors as the choice of the host cell to be transformed, the level of expression of protein desired, etc. The expression vectors can be introduced into host cells to thereby produce proteins or peptides, including fusion proteins or peptides, encoded by nucleic acids as described herein.

Another aspect provides host cells into which a recombinant expression vector has been introduced. A host cell can be any prokaryotic cell (for example, *E. coli*) or eukaryotic cell (for example, yeast, insect, or mammalian cells (e.g., CHO cells)). Vector DNA can be introduced into prokaryotic or eukaryotic cells via conventional transformation or transfection techniques. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein may be prepared by any of a number of conventional techniques. For example, GIPR antigen binding proteins may be produced by recombinant expression systems, using any technique known in the art. See, e.g., Monoclonal Antibodies, Hybridomas: A New Dimension in Biological Analyses, Kennet et al. (eds.) Plenum Press, New York (1980); and Antibodies: A Laboratory Manual, Harlow and Lane (eds.), Cold Spring Harbor Laboratory Press, Cold Spring Harbor, N.Y. (1988).

Antigen binding proteins can be expressed in hybridoma cell lines (e.g., in particular antibodies may be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transfection procedures known in the art, as exemplified by U.S. Pat. Nos. 4,399,216; 4,912,040; 4,740,461; 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein: a light chain constant region: a light chain variable region: a heavy chain constant region (e.g., $C_H1$, $C_H2$ and/or $C_H3$); and/or another scaffold portion of a GIPR antigen binding protein. These nucleic acid sequences are inserted into an appropriate expression vector using standard ligation techniques. In one embodiment, the heavy or light chain constant region is appended to the C-terminus of the anti-GIPR specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences (formerly "Clontech"). Other useful vectors for cloning and expressing the antibodies and fragments include those described in Bianchi and McGrew, 2003, *Biotech. Biotechnol. Bioeng.* 84:439-44, which is hereby incorporated by reference. Additional suitable expression vectors are discussed, for example, in Methods Enzymol., vol. 185 (D. V. Goeddel, ed.), 1990, New York: Academic Press.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the GIPR antigen binding protein coding sequence: the oligonucleotide sequence encodes polyHis (such as hexaHis (SEQ ID NO: 3358)), or another "tag" such as FLAG®, HA (hemaglutinin influenza virus), or myc, for which commercially available antibodies exist. This tag is typically fused to the polypeptide upon expression of the polypeptide, and can serve as a means for affinity purification or detection of the GIPR antigen binding protein from the host cell. Affinity purification can be accomplished, for example, by column chromatography using antibodies against the tag as an affinity matrix. Optionally, the tag can subsequently be removed from the purified GIPR antigen binding protein by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, CA), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, MA) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells: (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thyrnidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds GIPR polypeptide. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one may manipulate the various pre- or pro-sequences to improve glycosylation or yield. For example, one may alter the peptidase cleavage site of a particular signal peptide, or add prosequences, which also may affect glycosylation. The final protein product may have, in the −1 position (relative to the first amino acid of the mature protein), one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning will typically contain a promoter that is recognized by the host organism and operably linked to the molecule encoding the GIPR antigen binding protein. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising a GIPR antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

An enhancer sequence may be inserted into the vector to increase transcription of DNA encoding light chain or heavy chain comprising a GIPR antigen binding protein by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin).

Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, *Nature* 312:768: the interleukin-4 receptor signal peptide described in EP Patent No. 0367 566: the type I interleukin-1 receptor signal peptide described in U.S. Pat. No. 4,968,607; the type II interleukin-1 receptor signal peptide described in EP Patent No. 0 460 846.

In one embodiment the leader sequence comprises SEQ ID NO: 3157 (MDMRVPAQLL GLLLLWLRGA RC) which is encoded by SEQ ID NO: 3158 (atggacatga gagtgcctgc acagctgctg ggcctgctgc tgctgtggct gagaggcgcc agatgc). In another embodiment the leader sequence comprises SEQ ID NO: 3159 (MAWALLLLTL LTQGTGSWA) which is encoded by SEQ ID NO: 3160 (atggcctggg ctctgctgct cctcaccctc ctcactcagg gcacagggtc ctgggcc).

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising a GIPR antigen binding sequence has been inserted into the proper site of the vector, the completed vector may be inserted into a suitable host cell for amplification and/or polypeptide expression. The transformation of an expression vector for an antigen-binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines may be selected through determining which cell lines have high expression levels and constitutively produce antigen binding proteins with GIPR binding properties. In another embodiment, a cell line from the B cell lineage that does not make its own antibody but has a capacity to make and secrete a heterologous antibody can be selected.

In one embodiment, the present invention is directed to an antigen binding protein produced by a cell expressing one or more of the polynucleotides identified in Tables 2, 3, 4, and 5.

In one aspect, a GIPR binding protein is administered for chronic treatment. In another aspect, the binding proteins are administered for acute therapy.

Pharmaceutical compositions that comprise a GIPR antigen binding protein are also provided and can be utilized in any of the preventive and therapeutic methods disclosed herein. In an embodiment, a therapeutically effective amount of one or a plurality of the antigen binding proteins and a pharmaceutically acceptable diluent, carrier, solubilizer, emulsifier, preservative, and/or adjuvant are also provided. Acceptable formulation materials are nontoxic to recipients at the dosages and concentrations employed.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials: antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. REMINGTON'S PHARMACEUTICAL SCIENCES, 18" Edition, (A.R. Genrmo, ed.), 1990, Mack Publishing Company provides additional details and options for suitable agents that can be incorporated into the pharmaceutical compositions.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins disclosed. In certain embodiments, the primary vehicle or carrier in a pharmaceutical composition may be either aqueous or non-aqueous in nature. For example, a suitable vehicle or carrier may be water for injection or physiological saline solution. In certain embodiments, GIPR antigen binding protein compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the GIPR antigen binding protein may be formulated as a lyophilizate using appropriate excipients such as sucrose.

The pharmaceutical compositions can be selected for parenteral delivery. Alternatively, the compositions may be selected for inhalation or for delivery through the digestive tract, such as orally. Preparation of such pharmaceutically acceptable compositions is within the skill of the art.

The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions may be provided in the form of a pyrogen-free, parenterally acceptable aqueous solution comprising the desired human GIPR antigen binding protein in a pharmaceutically acceptable vehicle. A particularly suitable vehicle for parenteral injection is sterile distilled water in which the GIPR antigen binding protein is formulated as a sterile, isotonic solution, properly preserved.

In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Certain pharmaceutical compositions are formulated for inhalation. In some embodiments, GIPR antigen binding proteins are formulated as a dry, inhalable powder. In specific embodiments. GIPR antigen binding protein inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins. Some formulations can be administered orally. GIPR antigen binding proteins that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized. Additional agents can be included to facilitate absorption of the GIPR antigen binding protein. Diluents, flavorings, low melting point waxes, vegetable oils, lubricants, suspending agents, tablet disintegrating agents, and binders may also be employed.

Some pharmaceutical compositions comprise an effective quantity of one or a plurality of GIPR antigen binding proteins in a mixture with non-toxic excipients that are suitable for the manufacture of tablets. By dissolving the tablets in sterile water, or another appropriate vehicle, solutions may be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving GIPR binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, *Biopolymers* 2:547-556), poly(2-hydroxyethyl-inethacrylate) (Langer et al., 1981, *J. Biomed. Mater. Res.* 15:167-277 and Langer, 1982, *Chem. Tech.* 12:98-105), ethylene vinyl acetate (Langer et al., 1981, supra) or poly-D(−)-3-hydroxy butyric acid (European Patent Application Publication No. EP 133,988). Sustained release compositions may also include liposomes that can be prepared by any of several methods known in the art. See. e.g., Eppstein et al., 1985, *Proc. Natl. Acad. Sci. U.S.A.* 82:3688-3692: European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

In certain formulations, an antigen binding protein has a concentration of at least 10 mg/mL, 20 mg/mL, 30 mg/mL, 40 mg/mL, 50 mg/mL, 60) mg/mL, 70 mg/mL, 80 mg/mL, 90 mg/mL. 100 mg/mL or 150 mg/mL. In one embodiment, a pharmaceutical composition comprises the antigen binding protein, a buffer and polysorbate. In other embodiments, the pharmaceutical composition comprises an antigen binding protein, a buffer, sucrose and polysorbate. An example of a pharmaceutical composition is one containing 50-100 mg/mL of antigen binding protein, 5-20 mM sodium acetate, 5-10% w/v sucrose, and 0.002-0.008% w/v polysorbate. Certain, compositions, for instance, contain 65-75 mg/mL of an antigen binding protein in 9-11 mM sodium acetate buffer, 8-10% w/v sucrose, and 0.005-0.006% w/v polysorbate. The pH of certain such formulations is in the range of 4.5-6. Other formulations have a pH of 5.0-5.5 (e.g., pH of 5.0, 5.2 or 5.4).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of a GIPR antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the GIPR antigen binding protein is being used, the route of administration, and the size (body weight, body surface or organ size) and/or condition (the age and general health) of the patient. In certain embodiments, the clinician may titer the dosage and modify the route of administration to obtain the optimal therapeutic effect.

Dosing frequency will depend upon the pharmacokinetic parameters of the particular GIPR antigen binding protein in the formulation used. Typically, a clinician administers the composition until a dosage is reached that achieves the desired effect. The composition may therefore be administered as a single dose, or as two or more doses (which may or may not contain the same amount of the desired molecule) over time, or as a continuous infusion via an implantation device or catheter. Appropriate dosages may be ascertained through use of appropriate dose-response data. In certain embodiments, the antigen binding proteins can be administered to patients throughout an extended time period. In certain embodiments, the antigen binding protein is dosed every two weeks, every month, every two months, every three months, every four months, every five months, or every six months.

The route of administration of the pharmaceutical composition is in accord with known methods, e.g., orally, through injection by intravenous, intraperitoneal, intracerebral (intra-parenchymal), intracerebroventricular, intramuscular, intra-ocular, intraarterial, intraportal, or intralesional routes; by sustained release systems or by implantation devices. In certain embodiments, the compositions may be administered by bolus injection or continuously by infusion, or by implantation device.

The composition also may be administered locally via implantation of a membrane, sponge or another appropriate material onto which the desired molecule has been absorbed or encapsulated. In certain embodiments, where an implantation device is used, the device may be implanted into any suitable tissue or organ, and delivery of the desired molecule may be via diffusion, timed-release bolus, or continuous administration.

It also may be desirable to use GIPR antigen binding protein pharmaceutical compositions according to the disclosed ex vivo. In such instances, cells, tissues or organs that have been removed from the patient are exposed to GIPR antigen binding protein pharmaceutical compositions after which the cells, tissues and/or organs are subsequently implanted back into the patient.

A physician will be able to select an appropriate treatment indication and target lipid levels depending on the individual profile of a particular patient. One well-accepted standard for guiding treatment of hyperlipidemia is the Third Report of the National Cholesterol Education Program (NCEP) Expert Panel on Detection, Evaluation, and Treatment of the High Blood Cholesterol in Adults (Adult Treatment Panel III) Final Report, National Institutes of Health, NIH Publication No. 02-5215 (2002), the printed publication of which is hereby incorporated by reference in its entirety.

The efficacy of a particular dose can be assessed by reference to biomarkers or improvement in certain physiological parameters. Examples of suitable biomarkers include, the ratio of free cholesterol to plasma lipid, free cholesterol to membrane protein, phospatidylcholine to sphingomyelin, or HDL-C levels.

Also provided herein are compositions comprising a GIPR antigen binding protein and one or more additional therapeutic agents, as well as methods in which such agents are administered concurrently or sequentially with a GIPR antigen binding protein for use in the preventive and therapeutic methods disclosed herein. The one or more additional agents can be co-formulated with a GIPR antigen binding protein or can be co-administered with a GIPR antigen binding protein. In general, the therapeutic methods, compositions and compounds may also be employed in combination with other therapeutics in the treatment of various disease states, with the additional agents being administered concurrently.

A "GLP-1 receptor agonist" refers to compounds having GLP-1 receptor activity. Such exemplary compounds include exendins, exendin agonists, GLP-1(7-37), GLP-1(7-37) analogs, GLP-1(7-37) agonists, and the like. The terms "GLP-1 receptor agonist" and "GLP-1 receptor agonist compound" have the same meaning.

The term "exendin" includes naturally occurring (or synthetic versions of naturally occurring) exendin peptides that are found in the salivary secretions of the Gila monster. Exendins of particular interest include exendin-3 and exendin-4. The exendins, exendin analogs, and exendin agonists for use in the methods described herein may optionally be amidated, and may also be in an acid form, pharmaceutically acceptable salt form, or any other physiologically active form of the molecule.

In one embodiment, the GLP-1 receptor agonist is GLP-1(7-37) or a GLP-1(7-37) analog.

In one embodiment, administration of at least one GLP-1 receptor agonist in combination with administration of at least one GIPR antagonist provides sustained beneficial effects of at least one symptom of a metabolic disorder.

In one embodiment, the therapeutically effective amounts of a GLP-1 receptor agonist and a GIPR antagonist are synergistically effective amounts.

Exendin-4 (HGEGTFTSDLSKQMEEEAVRLFIEWLKNGGPSSGAPPPS-NH2 (SEQ ID NO: 3163)) is a peptide found in the saliva of the Gila monster, *Heloderma suspectum*; and exendin-3 (HSDGTFTSDLSKQMEEEAVRLFIEWLKNGGPSSGAPPPS-NH2 (SEQ ID NO: 3164)) is a peptide found in the saliva of the beaded lizard, *Heloderma horridum*. Exendins have some amino acid sequence similarity to some members of the glucagon-like peptide (GLP) family. For example, exendin-4 has about 53% sequence identity with glucagon-like peptide-1 (GLP- 1) (7-37) (HAEGTFTSDVSSYLEGQAAKEFIAWLVKGRG (SEQ ID NO: 3182)). However, exendin-4 is transcribed from a distinct gene, not the Gila monster homolog of the mammalian proglucagon gene from which GLP-1 is expressed. Additionally, exendin-4 is not an analog of GLP-1(7-37) because the structure of synthetic exendin-4 peptide was not created by sequential modification of the structure of GLP-1. Nielsen et al., Current Opinion in Investigational Drugs, 4 (4): 401-405 (2003).

"Exendin analog" refers to peptides which elicit a biological activity of an exendin reference peptide, preferably having a potency equal to or better than the exendin reference peptide (e.g., exendin-4), or within five orders of magnitude (plus or minus) of potency compared to the exendin reference peptide, when evaluated by art-known measures such as receptor binding and/or competition studies as described, e.g., by Hargrove et al., Regulatory Peptides, 141:113-119 (2007), the disclosure of which is incorporated by reference herein. Preferably, the exendin analogs will bind in such assays with an affinity of less than 1 μM, and more preferably with an affinity of less than 3 nM, less than 1 nM, or less than 0.1 nM. The term "exendin analog" may also be referred to as "exendin agonist". In a preferred embodiment, the exendin analog is an exendin-4 analog.

Exemplary exendins and exendin analogs exendin-4 (SEQ ID NO: 3163); exendin-3 (SEQ ID NO: 3164); $Leu^{14}$-exendin-4 (SEQ ID NO: 3165); $Leu^{14}$,$Phe^{25}$-exendin-4 (SEQ ID NO: 3166); $Leu^{14}$,$Ala^{19}$,$Phe^{25}$-exendin-4 (SEQ ID NO: 3167); exendin-4(1-30) (SEQ ID NO: 3168); $Leu^{14}$-exendin-4(1-30) (SEQ ID NO: 3169); $Leu^{14}$,$Phe^{25}$-exendin-4(1-30) (SEQ ID NO: 3170); $Leu^{14}$,$Ala^{19}$,$Phe^{25}$-exendin-4(1-30) (SEQ ID NO: 3171); exendin-4(1-28) (SEQ ID NO: 3172); $Leu^{14}$-exendin-4(1-28) (SEQ ID NO: 3173). $Leu^{14}$,$Phe^{23}$-exendin-4(1-28) (SEQ ID NO: 3174); $Leu^{14}$,$Ala^{19}$,$Phe^{25}$-exendin-4(1-28) (SEQ ID NO: 3175); $Leu^{14}$,$Lys^{17,20}$,$Ala^{19}$,$Glu^{21}$,$Phe^{25}$,$Gln^{28}$-exendin-4 (SEQ ID NO: 3176); $Leu^{14}$,$Lys^{17,20}$,$Ala^{19}$,$Glu^{21}$,$Gln^{28}$-exendin-4 (SEQ ID NO: 3177); $Phe^{4}$,$Leu^{14}$,$Gln^{28}$,$Lys^{33}$,$Glu^{34}$,$Ile^{35,36}$,$Ser^{37}$-exendin-4(1-37) (SEQ ID NO: 3178); $Phe^{4}$,$Leu^{14}$,$Lys^{17,20}$,$Ala^{12}$,$Glu^{21}$,$Gln^{28}$-exendin-4 (SEQ ID NO: 3179); $Val^{11}$,$Ile^{13}$,$Leu^{14}$,$Ala^{16}$,$Lys^{21}$,$Phe^{25}$-exendin-4 (SEQ ID NO: 3180), and exendin-4-$Lys^{40}$ (SEQ ID NO: 3181)

In one embodiment, the GLP-1 receptor agonist compound is an exendin-4 analog that has at least 80% sequence identity to exendin-4 (SEQ ID NO: 3163); at least 85% sequence identity to exendin-4 (SEQ ID NO: 3163); at least 90% sequence identity to exendin-4 (SEQ ID NO: 3163); or at least 95% sequence identity to exendin-4 (SEQ ID NO: 3163).

"GLP-1(7-37) analogs" refers to peptides which elicit a biological activity similar to that of GLP-1(7-37), when evaluated by art-known measures such as receptor binding assays or in vivo blood glucose assays as described, e.g., by Hargrove et al., *Regulatory Peptides,* 141:113-119 (2007), the disclosure of which is incorporated by reference herein. In one embodiment, the term "GLP-1(7-37) analog" refers to a peptide that has an amino acid sequence with 1, 2, 3, 4, 5, 6, 7 or 8 amino acid substitutions, insertions, deletions, or a combination of two or more thereof, when compared to the amino acid sequence of GLP-1(7-37). In some embodiments a simple nomenclature is used to describe the GLP-1 receptor agonist, e.g., [$Gly^{8}$] GLP-1(7-37) designates an analogue of GLP-1(7-37) wherein the naturally occurring Ala in position 8 has been substituted with Gly. Alternatively, the same molecule can be designated as "GLP1 A2G" or even more simply as "A2G". Similarly, [$Gly^{8}$, $His^{3}$, $Gly^{30}$]GLP-1(7-37) can be written as "GLP1 A2G/E3H/R30G" or as "A2G/E3H/R30G".

Exemplary GLP-1(7-37) and GLP-1(7-37) analogs include In one embodiment, the GLP-1 receptor agonist is GLP-1(7-37) or a GLP-1(7-37) analog. In one embodiment, the GLP-1 receptor agonist is selected from the group consisting of GLP-1(7-37) (SEQ ID NO: 3182);

(SEQ ID NO: 3163)
Exendin-4;

(SEQ ID NO: 3164)
Exendin-3;

(SEQ ID NO: 3165)
$Leu^{14}$-exendin-4;

(SEQ ID NO: 3166)
$Leu^{14}$, $Phe^{25}$-exendin-4;

(SEQ ID NO: 3167)
$Leu^{14}$, $Ala^{19}$, $Phe^{25}$-exendin-4;

(SEQ ID NO: 3168)
exendin-4(1-30);

(SEQ ID NO: 3169)
$Leu^{14}$-exendin-4(1-30);

(SEQ ID NO: 3170)
$Leu^{14}$, $Phe^{25}$-exendin-4(1-30);

(SEQ ID NO: 3171)
$Leu^{14}$, $Ala^{19}$, $Phe^{25}$-exendin-4(1-30);

(SEQ ID NO: 3172)
exendin-4(1-28);

(SEQ ID NO: 3173)
$Leu^{14}$-exendin-4(1-28);

(SEQ ID NO: 3174)
$Leu^{14}$, $Phe^{25}$-exendin-4(1-28);

(SEQ ID NO: 3175)
$Leu^{14}$, $Ala^{19}$, $Phe^{25}$-exendin-4(1-28);

(SEQ ID NO: 3176)
$Leu^{14}$, $Lys^{17,20}$, $Ala^{19}$, $Glu^{21}$, $Phe^{25}$, $Gln^{28}$-exendin-4;

(SEQ ID NO: 3177)
$Leu^{14}$, $Lys^{17,20}$, $Ala^{19}$, $Glu^{21}$, $Gln^{28}$-exendin-4;

(SEQ ID NO: 3178)
$Phe^{4}$, $Leu^{14}$, $Gln^{28}$, $Lys^{33}$, $Glu^{34}$, $Ile^{35,36}$, $Ser^{37}$-exendin-4(1-37);

(SEQ ID NO: 3179)
$Phe^{4}$, $Leu^{14}$, $Lys^{17,20}$, $Ala^{19}$, $Glu^{21}$, $Gln^{28}$-exendin-4;

(SEQ ID NO: 3180)
$Val^{11}$, $Ile^{13}$, $Leu^{14}$, $Ala^{16}$, $Lys^{21}$, $Phe^{25}$-exendin-4;

(SEQ ID NO: 3181)
exendin-4-$Lys^{40}$;

(SEQ ID NO: 3182)
GLP-1(7-37);

(SEQ ID NO: 3183)
$HXaa_{8}EGTFTSDVSSYLEXaa_{22}Xaa_{23}AAKEFIXaa_{30}WLXaa_{33}$ $Xaa_{34}G\ Xaa_{36}Xaa_{37}$;

wherein $Xaa_8$ is A, V, or G; $Xaa_{22}$ is G, K, or E; $Xaa_{23}$ is Q or K; $Xaa_{30}$ is A or E; $Xaa_{33}$ is V or K; $Xaa_{34}$ is K, N, or R; $Xaa_{36}$ is R or G; and $Xaa_{37}$ is G, H, P, or absent;

(SEQ ID NO: 3184)
$Arg^{34}$-GLP-1(7-37);

(SEQ ID NO: 3185)
$Glu^{30}$-GLP-1(7-37);

(SEQ ID NO: 3186)
$Lys^{22}$-GLP-1(7-37);

(SEQ ID NO: 3187)
$Gly^{8,36}$, $Glu^{22}$-GLP-1(7-37);

(SEQ ID NO: 3188)
$Val^{8}$, $Glu^{22}$, $Gly^{36}$-GLP-1(7-37);

(SEQ ID NO: 3189)
$Gly^{8,36}$, $Glu^{22}$, $Lys^{33}$, $Asn^{34}$-GLP-1(7-37);

(SEQ ID NO: 3190)
$Val^{8}$, $Glu^{22}$, $Lys^{33}$, $Asn^{34}$, $Gly^{36}$-GLP-1(7-37);

(SEQ ID NO: 3191)
$Gly^{8,36}$, $Glu^{22}$, $Pro^{37}$-GLP-1(7-37);

(SEQ ID NO: 3192)
$Val^{8}$, $Glu^{22}$, $Gly^{36}$, $Pro^{37}$-GLP-1(7-37);

(SEQ ID NO: 3193)
$Gly^{8,36}$, $Glu^{22}$, $Lys^{33}$, $Asn^{34}$, $Pro^{37}$-GLP-1(7-37);

(SEQ ID NO: 3194)
$Val^{8}$, $Glu^{22}$, $Lys^{33}$, $Asn^{34}$, $Gly^{36}$, $Pro^{37}$-GLP)-1(7-37);

(SEQ ID NO: 3195)
$Gly^{8,36}$, $Glu^{22}$-GLP-1(7-36);

(SEQ ID NO: 3196)
$Val^{8}$, $Glu^{22}$, $Gly^{36}$-GLP-1(7-36);

(SEQ ID NO: 3197)
$Val^{8}$, $Glu^{22}$, $Asn^{34}$, $Gly^{36}$-GLP-1(7-36);

(SEQ ID NO: 3198)
$Gly^{8,36}$, $Glu^{22}$, $Asn^{34}$-GLP-1(7-36);

(SEQ ID NO: 3199)
GLP-1 analog;

(SEQ ID NO: 3200)
GLP-1 analog;

(SEQ ID NO: 3201)
[$Gly^{8,36}$, $Glu^{22}$]GLP-1(7-37);

(SEQ ID NO: 3202)
HAEGTFTSDVSSYLEGQAAKEFIAWLVKGRG;

(SEQ ID NO: 3203)
AEGTFTSDVSSYLEGQAAKEFIAWLVKGRG;

(SEQ ID NO: 3204)
EGTFTSDVSSYLEGQAAKEFIAWLVKGRG;

(SEQ ID NO: 3205)
HGEGTFTSDVSSYLEGQAAKEFIAWLVKGRG;

(SEQ ID NO: 3206)
HGEGTFTSDVSSYLEGQAAKEFIAWLVKGR;

(SEQ ID NO: 3207)
HLEGTFTSDVSSYLEGQAAKEFIAWLVKGRG;

(SEQ ID NO: 3208)
HGEGTFTSDLSKQMEEEAVRLF;

(SEQ ID NO: 3209)
HGEGTFTSDLSKQMEEEAVRLFI;

(SEQ ID NO: 3210)
HGEGTFTSDVSSYLEGQAAKEFIAWLVKGGG;

(SEQ ID NO: 3211)
HGEGTFTSDLSKQMEEEAVRLAAQAAQQGGG;

(SEQ ID NO: 3212)
HSEGTFTSDVSSYLEEQAAKEFIAWLVKGGG;

(SEQ ID NO: 3213)
HSQGTFTSDVSSYLEEQAAKEFIAWLVKGGG;

(SEQ ID NO: 3214)
HGDGTFTSDVSSYLEEQAAKEFIAWLVKGGG;

(SEQ ID NO: 3215)
HSDGTFTSDVSSYLEEQAAKEFIAWLVKGGG;

(SEQ ID NO: 3216)
HSEGTFTSDVSSYLEEQAAKEFIEWLVKGGG;

(SEQ ID NO: 3217)
HSQGTFTSDVSSYLEEQAAKEFIEWLVKGGG;

(SEQ ID NO: 3218)
HGDGTFTSDVSSYLEEQAAKEFIEWLVKGGG;

(SEQ ID NO: 3219)
HSDGTFTSDVSSYLEEQAAKEFIEWLVKGGG;

(SEQ ID NO: 3220)
HGEGTFTSDVSSYLEEQAAKEFIAWLKNGGG;

(SEQ ID NO: 3221)
HSEGTFTSDVSSYLEEQAAKEFIAWLKNGGG;

(SEQ ID NO: 3222)
HSQGTFTSDVSSYLEEQAAKEFIAWLKNGGG;

(SEQ ID NO: 3223)
HGDGTFTSDVSSYLEEQAAKEFIAWLKNGGG;

(SEQ ID NO: 3224)
HSDGTFTSDVSSYLEEQAAKEFIAWLKNGGG;

(SEQ ID NO: 3225)
HSEGTFTSDVSSYLEEQAAKEFIEWLKNGGG;

(SEQ ID NO: 3226)
HSQGTFTSDVSSYLEEQAAKEFIEWLKNGGG;

(SEQ ID NO: 3227)
HGDGTFTSDVSSYLEEQAAKEFIEWLKNGGG;

(SEQ ID NO: 3228)
HSDGTFTSDVSSYLEEQAAKEFIEWLKNGGG;

(SEQ ID NO: 3229)
HGEGTFTSDVSSYLEEQAAKEFIEWLKNEGG;

(SEQ ID NO: 3230)
HSEGTFTSDVSSYLEEQAAKEFIEWLKNEGG;

(SEQ ID NO: 3231)
HGEGTFTSDVSSYLEEQAAKEFIEWLKNPGG;

(SEQ ID NO: 3232)
HSEGTFTSDVSSYLEEQAAKEFIEWLKNPGG;

(SEQ ID NO: 3233)
HGEGTFTSDVSSYLEEQAAKEFIEWLKNQGG;

(SEQ ID NO: 3234)
HSEGTFTSDVSSYLEEQAAKEFIEWLKNQGG;

-continued (SEQ ID NO: 3235)
HGEGTFTSDVSSYLEEQAAKEFIEWLKNTGG;

(SEQ ID NO: 3236)
HSEGTFTSDVSSYLEEQAAKEFIEWLKNTGG;

(SEQ ID NO: 3237)
HGEGTFTSDVSSYLEEQAAKEFIEWLKNVGG;

(SEQ ID NO: 3238)
HSEGTFTSDVSSYLEEQAAKEFIEWLKNVGG;

(SEQ ID NO: 3239)
HGEGTFTSDVSSYLEEQAAKEFIEWLKQGGG;

(SEQ ID NO: 3240)
HSEGTFTSDVSSYLEEQAAKEFIEWLKQGGG;

(SEQ ID NO: 3241)
HGEGTFTSDVSSYLEEQAAKEFIAWLVKGGG;

(SEQ ID NO: 3242)
HGEGTFTSDVSXYLEEQAAKEFIAWLVKGGG;

(SEQ ID NO: 3243)
HVEGTFTSDVSSYLEGQAAKEFIAWLVKGGG;

(SEQ ID NO: 3244)
HSEGTFTSDVSSYLEGQAAKEFIAWLVKGGG;

(SEQ ID NO: 3245)
HGQGTFTSDVSSYLEGQAAKEFIAWLVKGGG;

(SEQ ID NO: 3246)
HVQGTFTSDVSSYLEGQAAKEFIAWLVKGGG;

(SEQ ID NO: 3247)
HSQGTFTSDVSSYLEGQAAKEFIAWLVKGGG;

(SEQ ID NO: 3248)
HVDGTFTSDVSSYLEGQAAKEFIAWLVKGGG;

(SEQ ID NO: 3249)
HGHGTFTSDVSSYLEGQAAKEFIAWLVKGGG;

(SEQ ID NO: 3250)
HVHGTFTSDVSSYLEGQAAKEFIAWLVKGGG;

(SEQ ID NO: 3251)
HSHGTFTSDVSSYLEGQAAKEFIAWLVKGGG;

(SEQ ID NO: 3252)
HGDGTFTSDVSSYLEGQAAKEFIAWLVKGGG;

(SEQ ID NO: 3253)
HSDGTFTSDVSSYLEGQAAKEFIAWLVKGGG;

(SEQ ID NO: 3254)
HGEGTFTSDVSSYLEEQAAKEFIEWLKNGGG;

(SEQ ID NO: 3255)
HGEGTFTSDVSSYLEEQAAKEFIEWLVKGGG;

(SEQ ID NO: 3256)
HGEGTFTSDYSSYLEEQAAKEFIEWLKNGGG;

(SEQ ID NO: 3257)
HGEGTFTSEVSSYLEGQAAKEFIEWLKNGGG;

(SEQ ID NO: 3258)
HSEGTFTSDLSKQMEEEAVRLFAAQAAQQGGG;

(SEQ ID NO: 3259)
HSQGTFTSDLSKQMEEEAVRLFAAQAAQQGGG;

(SEQ ID NO: 3260)
HGDGTFTSDLSKQMEEEAVRLFAAQAAQQGGG;

(SEQ ID NO: 3261)
HSDGTFTSDLSKQMEEEAVRLFAAQAAQQGGG;

-continued (SEQ ID NO: 3262)
HGEGTFTSDLSKQMEEEAVRLFAAQAAQQGGG;

(SEQ ID NO: 3263)
HGEGTFTSDLSKQMEEEAVRLFIEWLKNGG;

(SEQ ID NO: 3264)
HGEGTFTSDVSSYLEGEAVRLFIEWLKNGG;

(SEQ ID NO: 3265)
HGEGTFTSDLSKQMEEEAVRLFIEWLKNGGPSSGAPPPS;

(SEQ ID NO: 3266)
HGEGTFTSDVSSYLEGEAVRLFIEWLKNGGPSSGAPPPS;

(SEQ ID NO: 3267)
HHGEGTFTSDVSSYLEEQAAKEFIEWLKNGGG;

(SEQ ID NO: 3268)
HHGEGTFTSDVSSYLEEQAAKEFIEWLKDGGG;

(SEQ ID NO: 3269)
HHGEGTFTSDVSSYLEEQAAKEFIEWLKQGGG;

(SEQ ID NO: 3270)
HHGEGTFTSDVSSYLEEQAAKEFIEWLKNQGG;

(SEQ ID NO: 3271)
HHGEGTFTSDVSSYLEEQAAKEFIEWLKNTGG;

(SEQ ID NO: 3272)
HHGEGTFTSDVSSYLEEQAAKEFIEWLKNVGG;

(SEQ ID NO: 3273)
HHGEGTFTSDVSSYLEEQAAKEFIEWLKNPGG;

(SEQ ID NO: 3274)
HHGEGTFTSDVSSYLEEQAAKEFIEWLKNEGG;

(SEQ ID NO: 3275)
HGAGTFTSDVSSYLEGQAAKEFIAWLVKG;

(SEQ ID NO: 3276)
HGDGTFTSDVSSYLEGQAAKEFIAWLVKG;

(SEQ ID NO: 3277)
HGLGTFTSDVSSYLEGQAAKEFIAWLVKG;

(SEQ ID NO: 3278)
HGVGTFTSDVSSYLEGQAAKEFIAWLVKG;

(SEQ ID NO: 3279)
HGFGTFTSDVSSYLEGQAAKEFIAWLVKG;

(SEQ ID NO: 3280)
HGYGTFTSDVSSYLEGQAAKEFIAWLVKG;

(SEQ ID NO: 3281)
HGTGTFTSDVSSYLEGQAAKEFIAWLVKG;

(SEQ ID NO: 3282)
HGNGTFTSDVSSYLEGQAAKEFIAWLVKG;

(SEQ ID NO: 3283)
HGHGTFTSDVSSYLEGQAAKEFIAWLVKG;

(SEQ ID NO: 3284)
HGKGTFTSDVSSYLEGQAAKEFIAWLVKG;

(SEQ ID NO: 3285)
HGIGTFTSDVSSYLEGQAAKEFIAWLVKG;

(SEQ ID NO: 3286)
HGWGTFTSDVSSYLEGQAAKEFIAWLVKG;

(SEQ ID NO: 3287)
HGPGTFTSDVSSYLEGQAAKEFIAWLVKG;

(SEQ ID NO: 3288)
HGSGTFTSDVSSYLEGQAAKEFIAWLVKG;

-continued (SEQ ID NO: 3289)
HGRGTFTSDVSSYLEGQAAKEFIAWLVKG;

(SEQ ID NO: 3290)
AHGEGTFTSDVSSYLEGQAAKEFIAWLVKG;

(SEQ ID NO: 3291)
GHGEGTFTSDVSSYLEGQAAKEFIAWLVKG;

(SEQ ID NO: 3292)
HHGEGTFTSDVSSYLEGQAAKEFIAWLVKG;

(SEQ ID NO: 3293)
HHEGTFTSDVSSYLEGQAAKEFIAWLVKG;

(SEQ ID NO: 3294)
HGEATFTSDVSSYLEGQAAKEFIAWLVKG;

(SEQ ID NO: 3295)
HGESTFTSDVSSYLEGQAAKEFIAWLVKG;

(SEQ ID NO: 3296)
HGEVTFTSDVSSYLEGQAAKEFIAWLVKG;

(SEQ ID NO: 3297)
HGEKTFTSDVSSYLEGQAAKEFIAWLVKG;

(SEQ ID NO: 3298)
HGEETFTSDVSSYLEGQAAKEFIAWLVKG;

(SEQ ID NO: 3299)
HGEGTFTSDVSSYLEGQAAKEFIAWLVKG;

(SEQ ID NO: 3300)
HVEGTFTSDVSSYLEGQAAKEFIAWLVKGRG;

(SEQ ID NO: 3301)
HSEGTFTSDVSSYLEGQAAKEFIAWLVKGRG;
and (SEQ ID NO: 3302)
HGQGTFTSDVSSYLEGQAAKEFIAWLVKGRG.

Peptidyl linkers. The linker moiety, if present, can be "peptidyl" in nature (i.e., made up of amino acids linked together by peptide bonds) and made up in length, preferably, of from 1 up to about 40 amino acid residues, more preferably, of from 10 up to about 30 amino acid residues, and most preferably of from 10 to about 20 amino acid residues. The amino acid residues in the linker are from among the twenty canonical amino acids, more preferably, glycine, alanine, proline, asparagine, glutamine, and/or serine. Even more preferably, a peptidyl linker is made up of a majority of amino acids that are sterically unhindered, such as glycine, serine, and alanine linked by a peptide bond. It is also desirable that, if present, a peptidyl linker be selected that avoids rapid proteolytic turnover in circulation in vivo. Some of these amino acids may be glycosylated, as is well understood by those in the art. For example, a useful linker sequence constituting a sialylation site is $X_1X_2NX_4X_5G$ (SEQ ID NO: 3337), wherein $X_1$, $X_2$, $X_4$ and $X_5$ are each independently any amino acid residue. Preferred linkers include polyglycines, polyserines, and polyalanines, or combinations of any of these. Some exemplary peptidyl linkers are poly$(Gly)_{1-8}$ (SEQ ID NO: 3360), particularly $(Gly)_3$, $(Gly)_4$ (SEQ ID NO: 3327), $(Gly)_5$ (SEQ ID NO:3338) and $(Gly)_7$ (SEQ ID NO:3339), as well as, GlySer and poly $(Gly)_4$Ser (SEQ ID NO: 3361), such as "L15" (GGGGSGGGGSGGGGS; SEQ ID NO:3340), poly$(Gly\text{-}Ala)_{2-4}$ (SEQ ID NO: 3362) and poly$(Ala)_{1-8}$ (SEQ ID NO: 3363). Other specific examples of peptidyl linkers include $(Gly)_5$Lys (SEQ ID NO:3341), and $(Gly)_5$LysArg (SEQ ID NO: 3342). Other examples of useful peptidyl linkers are: Other examples of useful peptidyl linkers are:

(SEQ ID NO: 3343)
$(Gly)_3Lys(Gly)_4$;

(SEQ ID NO: 3344)
$(Gly)_3$AsnGlySer$(Gly)_2$;

(SEQ ID NO: 3345)
$(Gly)_3Cys(Gly)_4$;
and (SEQ ID NO: 3345)
GlyProAsnGlyGly.

To explain the above nomenclature, for example, $(Gly)_3Lys(Gly)_4$ means Gly-Gly-Gly-Lys-Gly-Gly-Gly-Gly (SEQ ID NO:3346). Other combinations of Gly and Ala are also useful.

Other preferred linkers are those identified herein as "L5" (GGGGS; or "$G_4S$"; SEQ ID NO: 3347), "L10" (GGGGSGGGGS; SEQ ID NO:3348): "L20" (GGGGSGGGGSGGGGSGGGGS; SEQ ID NO:3349); "L25" (GGGGSGGGGSGGGGSGGGGSGGGGS; SEQ ID NO:3350) and any linkers used in the working examples hereinafter.

In some embodiments of the compositions of this invention, which comprise a peptide linker moiety, acidic residues, for example, glutamate or aspartate residues, are placed in the amino acid sequence of the linker moiety. Examples include the following peptide linker sequences: $(Gly_3Ser)_2$ (SEQ ID NO: 3303), $(Gly_4Ser)_2$ (SEQ ID NO: 3304), $(Gly_3Ser)_3$ (SEQ ID NO: 3305), $(Gly_4Ser)_3$ (SEQ ID NO: 3306), $(Gly_3Ser)_4$ (SEQ ID NO: 3307), $(Gly_4Ser)_4$ (SEQ ID NO: 3308), $(Gly_3Ser)_5$ (SEQ ID NO: 3309), $(Gly_4Ser)_5$ (SEQ ID NO: 3310), $(Gly_3Ser)_6$ (SEQ ID NO: 3311), $(Gly_4Ser)_6$ (SEQ ID NO: 3359), GGEGGG (SEQ ID NO: 3312):

(SEQ ID NO: 3313)
GGEEEGGG;

(SEQ ID NO: 3314)
GEEEG;

(SEQ ID NO: 3315)
GEEE;

(SEQ ID NO: 3316)
GGDGGG;

(SEQ ID NO: 3317)
GGDDDGG;

(SEQ ID NO: 3318)
GDDDG;

(SEQ ID NO: 3319)
GDDD;

(SEQ ID NO: 3320)
GGGGSDDSDEGSDGEDGGGGS;

(SEQ ID NO: 3321)
WEWEW;

(SEQ ID NO: 3322)
FEFEF;

(SEQ ID NO: 3323)
EEEWWW;

(SEQ ID NO: 3324)
EEEFFF;

-continued (SEQ ID NO: 3325)
WWEEEWW;

(SEQ ID NO: 3326)
FFEEEFF.

(SEQ ID NO: 3327)
GGGG;

(SEQ ID NO: 3328)
GGGGSGGGG;

(SEQ ID NO: 3329)
GAPAPAPAPG;

(SEQ ID NO: 3330)
GGGGAGGGGAGGGG;

(SEQ ID NO: 3331)
GAPAPAPAPAPAPG;

(SEQ ID NO: 3332)
GAPAPAPAPAPAPAPAPG;

(SEQ ID NO: 3333)
GGGGAGGGGAGGGGAGGGG;

(SEQ ID NO: 3334)
GAPAPAPAPAPAPAPAPAPAPG;

(SEQ ID NO: 3335)
GSGSATGGSGSVASSGSGSATGS;
and (SEQ ID NO: 3336)
GSGSATGGSGSVASSGSGSATHL.

In other embodiments, the linker constitutes a phosphorylation site, e.g., X1X2YX4X5G (SEQ ID NO:3351), wherein X1, X2, X4, and X5 are each independently any amino acid residue: X1X2SX4X5G (SEQ ID NO:3352), wherein X1, X2, X4 and X5 are each independently any amino acid residue: or X1X2TX4X5G (SEQ ID NO:3353), wherein X1, X2, X4 and X5 are each independently any amino acid residue.

The linkers shown here are exemplary: peptidyl linkers within the scope of this invention may be much longer and may include other residues. A peptidyl linker can contain, e.g., a cysteine, another thiol, or nucleophile for conjugation with a half-life extending moiety. In another embodiment, the linker contains a cysteine for conjugation to maleimide, iodoacetaamide or thioester, functionalized half-life extending moiety.

Another useful peptidyl linker is a large, flexible linker comprising a random Gly/Ser/Thr sequence, for example: GSGSATGGSGSTASSGSGSATH (SEQ ID NO:3356) or HGSGSATGGSGSTASSGSGSAT (SEQ ID NO:3354), that is estimated to be about the size of a 1 kDa PEG molecule.

Alternatively, a useful peptidyl linker may be comprised of amino acid sequences known in the art to form rigid helical structures (e.g., Rigid linker:-AEAAAKEAAAKEAAAK-AGG-//SEQ ID NO:3355).

EXAMPLES

Preparation of GLP1-GIPR Fusion Expression Constructs

A Golden Gate Assembly (GGA) strategy was used to create all sequences with the general molecule design described in FIGS. 3, 8, 13, 18, 25 and 28. Briefly, GGA relies upon TypeII restriction enzymes to cut and seamlessly ligate together multiple DNA fragments. In this example, the multiple DNA fragments consisted of a synthetic nucleic acid sequence (gBlock, Integrated DNA Technologies, Coralville, IA) encoding signal, GLP1 and linker peptides: another gBlock encoding anti-GIPR variable domains: an antibody constant domain fragment released from a Parts vector; and the expression vector backbone. Table 7 breaks out these representative fragments.

TABLE 7

Fragments Assembled to create GLP1-GIPR Fusion Constructs

| Fragment | Expression units encoded by the Fragment |
|---|---|
| gBlock1 | Signal Peptide-GLP1-Linker |
| gBlock2 | Variable domain of anti-GIPR antibody |
| Part | Constant domain corresponding to anti-GIPR variable domain |
| Vector | Desired Expression Vector |

This strategy allows mixing and matching of different GLP1-Linker combinations with different antibody chains. Repetitiveness in some linkers necessitated that portions of their sequence be split between the Signal-GLP1 gBlock and the anti-GIPR variable domain gBlock, but they otherwise followed the same strategy.

The GGA reactions were composed of 10 ng of gBlock1, 10 ng of gBlock2, 10 ng of the Part vector, 10 ng of the expression vector, 1 μl 10× Fast Digest Reaction Buffer+0.5 mM ATP (Thermo Fisher, Waltham, MA), 0.5 μl FastDigest Esp3I (Thermo Fisher, Waltham, MA), 1 μl T4 DNA Ligase (5 U/μl, Thermo Fisher, Waltham, MA) and water to 10 μl. The reactions were performed over 15 cycles consisting of a 2 minute digestion step at 37° C., and a 3 minute ligation step at 16° C. The 15 cycles were followed by a final 5 minute 37° C. digestion step and a 5 minute enzyme inactivation step at 80° C. The GGA product can then be directly transformed into competent cells for growth and screened by standard sequencing methods. Representative constructs as shown by amino acid composition are shown in Table 8.

TABLE 8 anti-GIPR antibodies and GLP-1/anti-GIPR antibody fusion polypeptides

| Lot(s) | Identifier | Description | Sequence 1 |
|---|---|---|---|
| PL-42410 | iPS: 373184 | [Unknown anti-<huGIPR> SS-18644.006 VK1 (1-236)(E88(92)C) VL]::huKLC-CL + [Unknown anti- | DIQMTQSPSSLSASIGDRVTITCRA SQDLRNYLGWYHQKPGKAPKRLI YGASSLQSGVPSRFSGSGSGTCFT LTISSLQPEDFATYYCLQHNNYPF TFGPGTKVDIKRTVAAPSVFIFPPS DEQLKSGTASVVCLLNNFYPREA |

TABLE 8-continued

| anti-GIPR antibodies and GLP-1/anti-GIPR antibody fusion polypeptides | | | |
|---|---|---|---|
| | | <huGIPR> 21-143_18F2 VH3 (1-473) VH]::huIgG1zSEFL2-2 (mAb) | KVQWKVDNALQSGNSQESVTEQ DSKDSTYSLSSTLTLSKADYEKH KVYACEVTHQGLSSPVTKSFNRG EC (SEQ ID NO: 3366) |
| PL-42411 | iPS: 373196 | [Unknown anti-<huGIPR> 21-143_18F2 VK1 (1-236) VL]::huKLC-CL + [Unknown anti-<huGIPR> SS-18644.008 VH3 (1-473)(E384(298)C) VH]::huIgG1zSEFL2-2_E384C (mAb) | DIQMTQSPSSLSASIGDRVTITCRA SQDLRNYLGWYHQKPGKAPKRLI YGASSLQSGVPSRFSGSGSGTEFT LTISSLQPEDFATYYCLQHNNYPF TFGPGTKVDIKRTVAAPSVFIFPPS DEQLKSGTASVVCLLNNFYPREA KVQWKVDNALQSGNSQESVTEQ DSKDSTYSLSSTLTLSKADYEKH KVYACEVTHQGLSSPVTKSFNRG EC (SEQ ID NO: 3367) |
| PL-42412 | iPS: 373202 | [Unknown anti-<huGIPR> 21-143_18F2 VK1 (1-236) VL]::huKLC-CL + [Unknown anti-<huGIPR> SS-18644.009 VH3 (1-473)(T487(385)C) VH]::huIgG1zSEFL2-2_T487C (mAb) | DIQMTQSPSSLSASIGDRVTITCRA SQDLRNYLGWYHQKPGKAPKRLI YGASSLQSGVPSRFSGSGSGTEFT LTISSLQPEDFATYYCLQHNNYPF TFGPGTKVDIKRTVAAPSVFIFPPS DEQLKSGTASVVCLLNNFYPREA KVQWKVDNALQSGNSQESVTEQ DSKDSTYSLSSTLTLSKADYEKH KVYACEVTHQGLSSPVTKSFNRG EC (SEQ ID NO: 3368) |
| PL-42409 PL-43909 | iPS: 373932 | [Unknown anti-<huGIPR> SS-18654.001 VK1 (1-236)(D88(92)C) VL]::huKLC-CL + [Unknown anti-<huGIPR> 21-143_5G12.005 VH3 (1-473) VH]::huIgG1zSEFL2-2 (mAb) | DIQLTQSPSSLSASVGDRVTITCR ASQTISRFLNWYQQKPGKAPELLI YVASSLQSGVPSRFSGSGSGTCFT LTISSLQPEDFATYYCQQSYSTLIS FGQGTKLEITRTVAAPSVFIFPPSD EQLKSGTASVVCLLNNFYPREAK VQWKVDNALQSGNSQESVTEQD SKDSTYSLSSTLTLSKADYEKHK VYACEVTHQGLSSPVTKSFNRGE C (SEQ ID NO: 3369) |
| PL-42476 | iPS: 373936 | [Unknown anti-<huGIPR> 5G12.006 (1-236)(D1(23)E) VL]::huKLC-CL + [Unknown anti-<huGIPR> 5G12.005 (1-473)(Q1(23)E) VH]::huIgG1zSEFL2-2 (mAb) | EIQLTQSPSSLSASVGDRVTITCRA SQTISRFLNWYQQKPGKAPELLIY VASSLQSGVPSRFSGSGSGTDFTL TISSLQPEDFATYYCQQSYSTLISF GQGTKLEITRTVAAPSVFIFPPSDE QLKSGTASVVCLLNNFYPREAKV QWKVDNALQSGNSQESVTEQDS KDSTYSLSSTLTLSKADYEKHKV YACEVTHQGLSSPVTKSFNRGEC (SEQ ID NO: 3370) |
| PL-42475 PL-43910 PL-49579 | iPS: 373941 | [Unknown anti-<huGIPR> 21-143_5G12.006 VK1 (1-236)(C137(118)I) VL]::huKLC-CL + [Unknown anti-<huGIPR> 5G12.005 (1-473)(E384(298)C) VH]::huIgG1zSEFL2-2_E384C (mAb) | DIQLTQSPSSLSASVGDRVTITCR ASQTISRFLNWYQQKPGKAPELLI YVASSLQSGVPSRFSGSGSGTDFT LTISSLQPEDFATYYCQQSYSTLIS FGQGTKLEITRTVAAPSVFIFPPSD EQLKSGTASVVCLLNNFYPREAK VQWKVDNALQSGNSQESVTEQD SKDSTYSLSSTLTLSKADYEKHK VYACEVTHQGLSSPVTKSFNRGE C (SEQ ID NO: 3371) |
| PL-42474 PL-43911 | iPS: 373945 | [Unknown anti-<huGIPR> 21-143_5G12.006 VK1 (1-236)(C137(118)I) VL]::huKLC-CL + [Unknown anti-<huGIPR> 5G12.005 (1-473)(T487(385)C) VH]::huIgG1zSEFL2-2_T487C (mAb) | DIQLTQSPSSLSASVGDRVTITCR ASQTISRFLNWYQQKPGKAPELLI YVASSLQSGVPSRFSGSGSGTDFT LTISSLQPEDFATYYCQQSYSTLIS FGQGTKLEITRTVAAPSVFIFPPSD EQLKSGTASVVCLLNNFYPREAK VQWKVDNALQSGNSQESVTEQD SKDSTYSLSSTLTLSKADYEKHK VYACEVTHQGLSSPVTKSFNRGE C (SEQ ID NO: 3372) |
| PL42477 | iPS: 373949 | [Unknown anti-<huGIPR> 21-143 18F2 (1-236)(D1(23)E) VL]::huKLC-CL + [Unknown anti-<huGIPR> 21-143 18F2 | EIQMTQSPSSLSASIGDRVTITCRA SQDLRNYLGWYHQKPGKAPKRLI YGASSLQSGVPSRFSGSGSGTEFT LTISSLQPEDFATYYCLQHNNYPF TFGPGTKVDIKRTVAAPSVFIFPPS DEQLKSGTASVVCLLNNFYPREA |

TABLE 8-continued

| anti-GIPR antibodies and GLP-1/anti-GIPR antibody fusion polypeptides | | | |
|---|---|---|---|
| | | (1-473)(Q1(23)E) VH]::huIgG1zSEFL2-2 (mAb) | KVQWKVDNALQSGNSQESVTEQDSKDSTYSLSSTLTLSKADYEKHKVYACEVTHQGLSSPVTKSFNRGEC (SEQ ID NO: 3373) |
| PL-42487 | iPS: 374770 | huGLP-1(R30G)::1KmodT482V, M493L)::[hu anti-<huGIPR> 21-143_4B1 VL]::huKLC + [Unknown anti-<huGIPR> 21-143_6H1 VH3 (1-473) VH]::huIgG1zSEFL2-2 (mAb-fusion) | HGEGTFTSDVSSYLEGQAAKEFIAWLVKGGGGSGSATGGSGSVASSGSGSATHLDIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3374) |
| PL-42834<br>PL-46306 | iPS: 374771 | huGLP-1(R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3375) |
| PL-42835<br>PL-42860 | iPS: 374772 | huGLP-1(R30G)::1KmodT482V, M493L)::[hu anti-<huGIPR> 21-143_5G12.006 (C137(118)I) VL]::huKLC + [Unknown anti-<huGIPR> 21-143_5G12.005 VH3 (1-473) VH]::huIgG1zSEFL2-2 (mAb-fusion) | HGEGTFTSDVSSYLEGQAAKEFIAWLVKGGGGSGSATGGSGSVASSGSGSATHLDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3376) |
| PL-42836<br>PL-42861<br>PL-43385<br>PL-43386 | iPS: 374773 | huGLP-1(R30G)::1KmodT482V, M493L)::[hu anti-<huGIPR> 21-143_5G12.005 VH]::huIgG1zSEFL2-2 + [Unknown anti-<huGIPR> 21-143_5G12.006 VK1 (1-236)(C137(118)I) VL]::huKLC-CL (mAb-fusion) | HGEGTFTSDVSSYLEGQAAKEFIAWLVKGGGGSGSATGGSGSVASSGSGSATHLQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3377) |
| PL-42837 | iPS: 374774 | huGLP-1(R30G)::1KmodT482V, M493L)::[hu anti-<huGIPR> 21-143_18F2 VL]::huKLC + [Unknown anti-<huGIPR> 21-143_18F2 VH3 (1-473) VH]::huIgG1zSEFL2-2 (mAb-fusion) | HGEGTFTSDVSSYLEGQAAKEFIAWLVKGGGGSGSATGGSGSVASSGSGSATHLDIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3378) |
| PL-43383<br>PL-43384 | iPS: 374775 | huGLP-1(R30G)::1KmodT482V, M493L)::[hu anti-<huGIPR> 21-143_18F2 VH]::huIgG1zSEFL2-2 + [Unknown anti-<huGIPR> 21-143_18F2 | HGEGTFTSDVSSYLEGQAAKEFIAWLVKGGGGSGSATGGSGSVASSGSGSATHLQVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHIFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKT |

TABLE 8-continued

| anti-GIPR antibodies and GLP-1/anti-GIPR antibody fusion polypeptides | | | |
|---|---|---|---|
| | | VK1 (1-236) VL]::huKLC-CL (mAb-fusion) | KPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3379) |
| PL-42471 PL-47504 PL-42815 PL-42816 PL- | iPS: 375070 | [hu anti-<*DNP> 3A4 (W101F) VH]::huIgG1zSEFL2-2_E384C + [hu anti-<*DNP> 3A4 VL]::huKLC (mAb) | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNFNYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3380) |
| PL-42838 PL-42839 | iPS: 376451 | gila monsterExendin-4(1-21)::1AQ1K(modV, GS)::[hu anti-<huGLP-1R> 3E6 VL]::huKLC + [hu anti-<huGLP-1R> 3E6.1 VH]::huIgG2TO (mAb) | HGEGTFTSDLSKQMEEEAVRLAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3381) |
| PL-42840 PL-42841 | iPS: 37452 | gila monsterExendin-4(1-22)::1AQ1K(modV, GS)::[hu anti-<huGLP-1R> 3E6VL]::huKLC + [hu anti-<huGLP-1R> 3E6.1 VH]::huIgG2TO (mAb) | HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3382) |
| PL-42842 PL-42843 | iPS: 376453 | gila monsterExendin-4(1-22)::1K(modV, GS)::[hu anti-<huGLP-1R> 3E6 VL]::huKLC + [hu anti-<huGLP-1R> 3E6.1 VH]::huIgG2TO (mAb) | HGEGTFTSDLSKQMEEEAVRLFGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3383) |
| PL-42844 PL-43387 PL-43388 PL-43389 PL-42862 | iPS: 376454 | gila monsterExendin-4(1-23)::1K(modV, GS)::[hu anti-<huGLP-1R> 3E6 VL]::huKLC + [hu anti-<huGLP-1R> 3E6.1 VH]::huIgG2TO (mAb) | HGEGTFTSDLSKQMEEEAVRLFIGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3384) |
| PL-42465 | iPS: 382976 | [Chimera mu anti-<huGLP-1R> 20M4.3 VH]::huIgG2TO + [Chimera mu anti-<huGLP-1R> 20M4.3 VL]::huKLC (mAb) | QVTLKESGPGILQPSQTLSLTCSFSGFSLSTFGMGVGWIRQPPGKGLEWLAHIWWDDDKYYNPALKSRLTISKDTSKNQVFLKIANVDTADTATYYCARKGNFAWFTYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK (SEQ ID NO: 3385) |
| PL-45575 | iPS: 398842 | [Unknown anti-<huGIPR> 21-143_4B1VL.001 (1- | DIQMTQSPSSLSASIGDRVTITCRASQDIRDYLGWYQQKPGKAPKRLIYGASSLQSGVPSRFSGSGSGTCFT |

TABLE 8-continued

| anti-GIPR antibodies and GLP-1/anti-GIPR antibody fusion polypeptides | | | |
|---|---|---|---|
| | | 236)(E88(92)C)<br>VL]::huKLC-CL +<br>[Unknown anti-<br><huGIPR> 21-143_6H1<br>VH3 (1-473)<br>VH]::huIgG1zSEFL2-2<br>(mAb) | LTISSLQPEDFATYYCLQHNNYPF<br>TFGPGTKVDIKRTVAAPSVFIFPPS<br>DEQLKSGTASVVCLLNNFYPREA<br>KVQWKVDNALQSGNSQESVTEQ<br>DSKDSTYSLSSTLTLSKADYEKH<br>KVYACEVTHQGLSSPVTKSFNRG<br>EC (SEQ ID NO: 3386) |
| PL-45573 | iPS:<br>398860 | [Unknown anti-<br><huGIPR> 21-143_4B1<br>VK1 (1-236)<br>VL]::huKLC-CL +<br>[Unknown anti-<br><huGIPR> 21-<br>143_6H1.004<br>(T487(385)C)<br>VH]::huIgG1zSEFL2-<br>2T487C (mAb) | DIQMTQSPSSLSASIGDRVTITCRA<br>SQDIRDYLGWYQQKPGKAPKRLI<br>YGASSLQSGVPSRFSGSGSGTEFT<br>LTISSLQPEDFATYYCLQHNNYPF<br>TFGPGTKVDIKRTVAAPSVFIFPPS<br>DEQLKSGTASVVCLLNNFYPREA<br>KVQWKVDNALQSGNSQESVTEQ<br>DSKDSTYSLSSTLTLSKADYEKH<br>KVYACEVTHQGLSSPVTKSFNRG<br>EC (SEQ ID NO: 3387) |
| PL-45574 | iPS:<br>398863 | [Unknown anti-<br><huGIPR> 21-143_4B1<br>VK1 (1-236)<br>VL]::huKLC-CL +<br>[Unknown anti-<br><huGIPR> 21-<br>143_6H1.005 (1-473)<br>VH]::huIgG1zSEFL2-<br>2E384C (mAb) | DIQMTQSPSSLSASIGDRVTITCRA<br>SQDIRDYLGWYQQKPGKAPKRLI<br>YGASSLQSGVPSRFSGSGSGTEFT<br>LTISSLQPEDFATYYCLQHNNYPF<br>TFGPGTKVDIKRTVAAPSVFIFPPS<br>DEQLKSGTASVVCLLNNFYPREA<br>KVQWKVDNALQSGNSQESVTEQ<br>DSKDSTYSLSSTLTLSKADYEKH<br>KVYACEVTHQGLSSPVTKSFNRG<br>EC (SEQ ID NO: 3388) |
| PL-45588<br>PL-45589 | iPS:<br>411889 | huGLP-<br>1(R30G)::1KmodT482V,<br>M493L)::[hu anti-<br><*DNP> 3B1<br>VH]::huIgG1zSEFL2-2 +<br>[hu anti-<*DNP> 3B1<br>VL]::huKLC (Fc<br>Fusion) | HGEGTFTSDVSSYLEGQAAKEFIAWLVKGGGGSGSATGGSGSVASSGSGS<br>ATHLQVQLQESGPGLVKPSETLSLTCTVSGGSISSYYWSWIRQPPGKGLEWI<br>GYIYYSGNTNSNPSLKSRVTISVDTSKNQFSLKLSSVTAADTAVYYCARTY<br>YDSSGYYYRAFDIWGQGTMVTVSSASTKGPSVFPLAPSSKSTSGGTAALGC<br>LVKDYFPEPVTVSWNSGALTSGVHTFPAVLQSSGLYSLSSVVTVPSSSLGT<br>QVYTLPPSREEMTKNQVSLTCLVKGFYPSDIAVEWESNGQPENNYKTTPPV<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QTYICNVNHKPSNTKVDKKVEPKSCDKTHTCPPCPAPELLGGPSVFLFPPKP<br>LDSDGSFFLYSKLTVDKSRWQQGNVFSCSVMHEALHNHYTQKSLSLSPGK<br>(SEQ ID NO: 3389) |
| PL-45590 | iPS:<br>411892 | huGLP-1(R30G,<br>G16E)::1KmodT482V,<br>M493L)::[hu anti-<br><*DNP> 3B1<br>VH]::huIgG1zSEFL2-2 +<br>[hu anti-<*DNP> 3B1<br>VL]::huKLC (Fc<br>Fusion) | HGEGTFTSDVSSYLEEQAAKEFIAWLVKGGGGSGSATGGSGSVASSGSGSA<br>THLQVQLQESGPGLVKPSETLSLTCTVSGGSISSYYWSWIRQPPGKGLEWIG<br>YIYYSGNTNSNPSLKSRVTISVDTSKNQFSLKLSSVTAADTAVYYCARTYY<br>DSSGYYYRAFDIWGQGTMVTVSSASTKGPSVFPLAPSSKSTSGGTAALGCL<br>VKDYFPEPVTVSWNSGALTSGVHTFPAVLQSSGLYSLSSVVTVPSSSLGTQ<br>TYICNVNHKPSNTKVDKKVEPKSCDKTHTCPPCPAPELLGGPSVFLFPPKPK<br>DTLMISRTPEVTCVVVDVSHEDPEVKFNWYVDGVEVHNAKTKPCEEQYGS<br>TYRCVSVLTVLHQDWLNGKEYKCKVSNKALPAPIEKTISKAKGQPREPQV<br>YTLPPSREEMTKNQVSLTCLVKGFYPSDIAVEWESNGQPENNYKTTPPVLD<br>SDGSFFLYSKLTVDKSRWQQGNVFSCSVMHEALHNHYTQKSLSLSPGK<br>(SEQ ID NO: 3390) |
| PL-45584<br>PL-45585 | iPS:<br>411895 | huGLP-<br>1(R30G)::1KmodT482V,<br>M493L)::[hu anti-<br><huTRAILR2> XG1-<br>048 (Y133(125)A)<br>VH]::huIgG1zSEFL2-2 +<br>[hu anti-<huTR2><br>XG1-048 (1-108)(Y53E)<br>VL]::huKLC (Fc<br>Fusion) | HGEGTFTSDVSSYLEGQAAKEFIAWLVKGGGGSGSATGGSGSVASSGSGS<br>ATHLQVQLQESGPGLVKPSQTLSLTCTVSGGSISSGDYFWSWIRQLPGKGL<br>EWIGHIHNSGTTYYNPSLKSRVTISVDTSKKQFSLRLSSVTAADTAVYYCA<br>RDRGGDYAYGMDVWGQGTTVTVSSASTKGPSVFPLAPSSKSTSGGTAALG<br>CLVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKFIVPV<br>LDSDGSFFLYSKLTVDKSRWQQGNVFSCSVMHEALHNHYTQKSLSLSPGK<br>(SEQ ID NO: 3391) |
| PL-45586<br>PL-45587 | iPS:<br>411898 | huGLP-<br>1(R30G, G16E)::1Kmod<br>T482V, M493L)::[hu<br>anti-<huTRAILR2><br>XG1-048(Y133(125)A)<br>VH]::huIgG1zSEFL2-2 +<br>[hu anti-<huTR2><br>XG1-048 (1-108)(Y53E)<br>VL]::huKLC (Fc<br>Fusion) | HGEGTFTSDVSSYLEEQAAKEFIAWLVKGGGGSGSATGGSGSVASSGSGSA<br>THLQVQLQESGPGLVKPSQTLSLTCTVSGGSISSGDYFWSWIRQLPGKGLE<br>WIGHIHNSGTTYYNPSLKSRVTISVDTSKKQFSLRLSSVTAADTAVYYCAR<br>DRGGDYAYGMDVWGQGTTVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKFIVPV<br>LDSDGSFFLYSKLTVDKSRWQQGNVFSCSVMHEALHNHYTQKSLSLSPGK<br>(SEQ ID NO: 3392) |

TABLE 8-continued anti-GIPR antibodies and GLP-1/anti-GIPR antibody fusion polypeptides

| | | | |
|---|---|---|---|
| PL-45556 PL-47367 | iPS: 412489 | huGLP-1(R30G, G16E)::1KmodT482V, M493L)::[hu anti-<huGIPR> 21-143_6H1 VH]::huIgG1z-SEFL2-2 + [Unknown anti-<huGIPR> 21-143_4B1 VK1 (1-236) VL]::huKLC-CL (mAb-fusion) | HGEGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3393) |
| PL-45557 | iPS: 412490 | huExendin4::1KmodT482V, M493L)::[hu anti-<huGIPR> 21-143_6H1 VH]::huIgG1z-SEFL2-2 + [Unknown anti-<huGIPR> 21-143_4B1 VK1 (1-236) VL]::huKLC-CL (mAb-fusion) | HGEGTFTSDLSKQMEEEAVRLFIEWLKNGGPSSGAPPPSGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3394) |
| PL-45557 PL-45558 | iPS-412490 | huExendin4::1KmodT482V, M493L)::[hu anti-<huGIPR> 21-143_6H1 VH]::huIgG1z-SEFL2-2 + [Unknown anti-<huGIPR> 21-143_4B1 VK1 (1-236) VL]::huKLC-CL (mAb-fusion) | HGEGTFTSDLSKQMEEEAVRLFIEWLKNGGPSSGAPPPSGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3395) |
| PL-45578 | iPS: 412491 | huGLP-1(A2G, R30G)::G4::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3396) |
| PL-45579 | iPS: 412493 | huGLP-1(A2G, R30G)::G4S::G4 [hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGGGGSGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3397) |
| PL-45580 | iPS: 412494 | huGLP-1(A2G, R30G)::(G4A)2:G4::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3398) |
| PL-45576 | iPS: 412724 | huGLP-1(A2G, R30G)::(G4A)4::G4::[hu anti-<huGIPR> 21-143_6H1 VH]::huIgG1zSEFL2-2 + [Unknown anti-<huGIPR> 21-143_4B1 | HGEGTFTSDVSSYLEGQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHIFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQY |

TABLE 8-continued

| anti-GIPR antibodies and GLP-1/anti-GIPR antibody fusion polypeptides | | | |
|---|---|---|---|
| | | VK1 (1-236) VL]::huKLC-CL (mAb-fusion) | GSTYRCVSVLTVLHQDWLNGKEYKCKVSNKALPAPIEKTISKAKGQPREPQVYTLPPSREEMTKNQVSLTCLVKGFYPSDIAVEWESNGQPENNYKFIVPVLDSDGSFFLYSKLTVDKSRWQQGNVFSCSVMHEALHNHYTQKSLSLSPGK (SEQ ID NO: 3399) |
| PL-45577 | iPS: 412725 | huGLP-1(A2G, R30G)::G::(AP)4::G::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3400) |
| PL-45581 | iPS: 412726 | huGLP-1(A2G, R30G)::G::(AP)6::G::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3401) |
| PL-45582 | iPS: 412727 | huGLP-1(A2G, R30G)::G::(AP)8::G::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3402) |
| PL-45583 | iPS: 412728 | huGLP-1(A2G, R30G)::G::(AP)10::G::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGEGTFTSDVSSYLEGQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKFIVPVLDSDGSFFLYSKLTVDKSRWQQGNVFSCSVMHEALHNHYTQKSLSLSPGK (SEQ ID NO: 3403) |
| PL-45559 | iPS: 412729 | huGLP-1(A2V, R30G)::1KmodT 482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HVEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3404) |
| PL-45560 | iPS: 412756 | huGLP-1(A2S, R30G)::1KmodT 482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HSEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3405) |

TABLE 8-continued anti-GIPR antibodies and GLP-1/anti-GIPR antibody fusion polypeptides

| | | | |
|---|---|---|---|
| PL-45561 | iPS: 412757 | huGLP-1(A2G, E3Q, R30G)::1K modT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3406) |
| PL-45562 | iPS: 412758 | huGLP-1(A2V, E3Q, R30G)::1K modT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HVQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3407) |
| PL-45563 | iPS: 412759 | huGLP-1(A2S, E3Q, R30G)::1K modT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HSQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3408) |
| PL-46301 | iPS: 420578 | [hu anti-<huGIPR> 21-143_2G10_LC1.003 VH3 (1-472)(S73(85)A, G65(77)A) VH]::huIgG1zSEFL2-2_E384C + [Unknown anti-<huGIPR> 21-143_2G10_LC1 VK3 (1-236) VL]::huKLC-CL (mAb) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3409) |
| PL-48080 | iPS: 420578 | [hu anti-<huGIPR> 21-143_2G10_LC1.003 VH3 (1-472)(S73(85)A, G65(77)A) VH]::huIgG1zSEFL2-2_E384C + [Unknown anti-<huGIPR> 21-143_2G10_LC1 VK3 (1-236) VL]::huKLC-CL (mAb) | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3410) |
| PL-45564 | iPS: 422050 | huGLP-1(A2V, E3D, R30G)::1K modT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HVDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3411) |
| PL-45565 | iPS: 422056 | huGLP-1(A2G, E3H, R30G)::1K modT482V, M493L)::[hu anti-<huGIPR> 21-143_6H1 | HGHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSL |

TABLE 8-continued anti-GIPR antibodies and GLP-1/anti-GIPR antibody fusion polypeptides

| | | | |
|---|---|---|---|
| | | VH]::huIgG1zSEFL2-2 + [Unknown anti-<huGIPR> 21-143_4B1 VK1 (1-236) VL]::huKLC-CL (mAb-fusion) | GTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3412) |
| PL-45565 PL-45566 | iPS: 422056 | huGLP-1(A2G, E3H, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3413) |
| PL-45567 PL-45568 | iPS: 422058 | huGLP-1(A2V, E3H, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HVHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3414) |
| PL-45569 | iPS: 422062 | huGLP-1(A2S, E3H, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HSHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3415) |
| PL-45570 | iPS: 422065 | huGLP-1(A2G, E3D, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HGDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3416) |
| PL-45571 | iPS: 422081 | huGLP-1(A2S, E3D, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | HSDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3417) |
| PL-45572 | iPS: 422084 | huGLP-1(0A, A2G, R30G)::1KmodT482V, M493L)::[hu anti-<huGIPR> 21-143_6H1 VH]::huIgG1zSEFL2-2 + [Unknown anti-<huGIPR> 21-143_4B1 VK1 (1-236) VL]::huKLC-CL (mAb-fusion) | AHGEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3418) |

TABLE 8-continued

| anti-GIPR antibodies and GLP-1/anti-GIPR antibody fusion polypeptides | | | |
|---|---|---|---|
| PL-47264 | iPS: 422961 | [hu anti-<huGLP-1R> 3E6.1VH]::huIgG1z-SEFL2-KDD + gila monsterExendin-4(1-22)::1AQ1K(modV, GS)::[hu anti-<huGLP-1R> 3E6VL]::huKLC-S176E + [anti-<huGIPR> 5G12.005 VH]::huIgG1z-SEFL2-EKK + [hu anti-<huGIPR> 21-143_5G12.006 VK1 (C137(118)I) VL]::huKLC-S176K (Hetero-Ig) | QVQLVESGGGVVQPGRSLRLSCAASGFTLSSYGMHWVRQAPGKGLEWVA VIWYDGSNKYYADSVKGRFTISRDNSKNTLYLQMNSLRAEDTAVYYCAR GGGSGSYRYYYYGLDVWGQGTTVTVSSASTKGPSVFPLAPSSKSTSGGTA ALGCLVKDYFPEPVTVSWNSGALTSGVHTFPAVLQSSGLYSLKSVVTVPSS SLGTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPCE EQYGSTYRCVSVLTVLHQDWLNGKEYKCKVSNKALPAPIEKTISKAKGQP REPQVYTLPPSREEMTKNQVSLTCLVKGFYPSDIAVEWESNGQPENNYDTT PPVLDSDGSFFLYSDLTVDKSRWQQGNVFSCSVMHEALHNHYTQKSLSLS PGK (SEQ ID NO: 3419) |
| PL-47265 | iPS: 422962 | [hu anti-<huGLP-1R> 3E6.1 (Q46(39)K) VH]::huIgG1z-SEFL2-KDD + gila monsterExendin-4(1-22)::1AQ1K(modV, GS)::[hu anti-<huGLP-1R> 3E6 (Q46(112)E) VL]::huKLC-S176E + [anti-<huGIPR> 5G12.005 (Q46E) VH]::huIgG1z-SEFL2-EKK + [hu anti-<huGIPR> 21-143_5G12.006 VK1 (Q46(38)K, C137(118)I) VL]::huKLC-S176K (Hetero-Ig) | QVQLVESGGGVVQPGRSLRLSCAASGFTLSSYGMHWVRKAPGKGLEWVA VIWYDGSNKYYADSVKGRFTISRDNSKNTLYLQMNSLRAEDTAVYYCAR GGGSGSYRYYYYGLDVWGQGTTVTVSSASTKGPSVFPLAPSSKSTSGGTA ALGCLVKDYFPEPVTVSWNSGALTSGVHTFPAVLQSSGLYSLKSVVTVPSS SLGTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPCE EQYGSTYRCVSVLTVLHQDWLNGKEYKCKVSNKALPAPIEKTISKAKGQP REPQVYTLPPSREEMTKNQVSLTCLVKGFYPSDIAVEWESNGQPENNYDTT PPVLDSDGSFFLYSDLTVDKSRWQQGNVFSCSVMHEALHNHYTQKSLSLS PGK (SEQ ID NO: 3420) |
| PL-47266 | iPS: 422963 | [hu anti-<huGLP-1R> 3E6.1 (G51(44)K) VH]::huIgG1z-SEFL2-KDD + gila monsterExendin-4(1-22)::1AQ1K(modV, GS)::[hu anti-<huGLP-1R> 3E6 (Q141(174)E) VL]::huKLC-S176E + [anti-<huGIPR> 5G12.005 (Q51G) VH]::huIgG1z-SEFL2-EKK + [hu anti-<huGIPR> 21-143_5G12.006 VK1 (Q141(100)K, C137(118)I) VL]::huKLC-S176K (Hetero-Ig) | QVQLVESGGGVVQPGRSLRLSCAASGFTLSSYGMHWVRQAPGKKLEWVA VIWYDGSNKYYADSVKGRFTISRDNSKNTLYLQMNSLRAEDTAVYYCAR GGGSGSYRYYYYGLDVWGQGTTVTVSSASTKGPSVFPLAPSSKSTSGGTA ALGCLVKDYFPEPVTVSWNSGALTSGVHTFPAVLQSSGLYSLKSVVTVPSS SLGTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPCE EQYGSTYRCVSVLTVLHQDWLNGKEYKCKVSNKALPAPIEKTISKAKGQP REPQVYTLPPSREEMTKNQVSLTCLVKGFYPSDIAVEWESNGQPENNYDTT PPVLDSDGSFFLYSDLTVDKSRWQQGNVFSCSVMHEALHNHYTQKSLSLS PGK (SEQ ID NO: 3421) |
| PL-47267 | iPS: 422964 | [hu anti-<huGLP-1R> 3E6.1VH]::huIgG1z-SEFL2-KDD + gila monsterExendin-4(1-22)::1AQ1K(modV, GS)::[hu anti-<huGLP-1R> 3E6 (C105Y) VL]::huKLC-S176E + [anti-<huGIPR> 5G12.005 VH]::huIgG1z-SEFL2-EKK + [hu anti-<huGIPR> 21-143_5G12.006 VK1 (C137(118)I) VL]::huKLC-S176K (Hetero-Ig) | QVQLVESGGGVVQPGRSLRLSCAASGFTLSSYGMHWVRQAPGKGLEWVA VIWYDGSNKYYADSVKGRFTISRDNSKNTLYLQMNSLRAEDTAVYYCAR GGGSGSYRYYYYGLDVWGQGTTVTVSSASTKGPSVFPLAPSSKSTSGGTA ALGCLVKDYFPEPVTVSWNSGALTSGVHTFPAVLQSSGLYSLKSVVTVPSS SLGTQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPCE EQYGSTYRCVSVLTVLHQDWLNGKEYKCKVSNKALPAPIEKTISKAKGQP REPQVYTLPPSREEMTKNQVSLTCLVKGFYPSDIAVEWESNGQPENNYDTT PPVLDSDGSFFLYSDLTVDKSRWQQGNVFSCSVMHEALHNHYTQKSLSLS PGK (SEQ ID NO: 3422) |
| PL-47268 | iPS: 422965 | [hu anti-<huGLP-1R> 3E6.1 (Q46(39)K) VH]::huIgG1z-SEFL2- | QVQLVESGGGVVQPGRSLRLSCAASGFTLSSYGMHWVRKAPGKGLEWVA VIWYDGSNKYYADSVKGRFTISRDNSKNTLYLQMNSLRAEDTAVYYCAR GGGSGSYRYYYYGLDVWGQGTTVTVSSASTKGPSVFPLAPSSKSTSGGTA |

TABLE 8-continued anti-GIPR antibodies and GLP-1/anti-GIPR antibody fusion polypeptides

| | | | |
|---|---|---|---|
| | | KDD + gila<br>monsterExendin-4(1-<br>22)::1AQ1K(modV, GS):<br>:[hu anti-<huGLP-1R><br>3E6 (Q46(112)E,<br>C105Y) VL]::huKLC-<br>S176E + [anti-<br><huGIPR> 5G12.005<br>(Q46E)VH]::huIgG1z-<br>SEFL2-EKK + [hu anti-<br><huGIPR> 21-<br>143_5G12.006 VK1<br>(Q46(38)K, C137(118)I)<br>VL]::huKLC-S176K<br>(Hetero-Ig) | ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3423) |
| PL-47269 | iPS:<br>422966 | [hu anti-<huGLP-1R><br>3E6.1 (G51(44)K)<br>VH]::huIgG1z-SEFL2-<br>KDD + gila<br>monsterExendin-4(1-<br>22)::1AQ1K(modV, GS):<br>:[hu anti-<huGLP-1R><br>3E6 (C105Y,<br>Q141(174)E)<br>VL]::huKLC-S176E +<br>[anti-<huGIPR><br>5G12.005 (Q51G)<br>VH]::huIgG1z-SEFL2-<br>EKK + [hu anti-<br><huGIPR> 21-<br>143_5G12.006 VK1<br>(Q141(100)K,<br>C137(118)I)<br>VL]::huKLC-S176K<br>(Hetero-Ig) | QVQLVESGGGVVQPGRSLRLSCAASGFTLSSYGMHWVRQAPGKKLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3424) |
| PL-47270 | iPS:<br>422967 | [hu anti-<huGLP-1R><br>3E6.1VH]::huIgG1z-<br>SEFL2-KDD + gila<br>monsterExendin-4(1-<br>22)::1AQ1K(modV, GS):<br>:[hu anti-<huGLP-1R><br>3E6 (C105S)<br>VL]::huKLC-S176E +<br>[anti-<huGIPR><br>5G12.005<br>VH]::huIgG1z-SEFL2-<br>EKK + [hu anti-<br><huGIPR> 21-<br>143_5G12.006 VK1<br>(C137(118)I)<br>VL]::huKLC-S176K<br>(Hetero-Ig) | QVQLVESGGGVVQPGRSLRLSCAASGFTLSSYGMHWVRQAPGKGLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3425) |
| PL-47271 | iPS:<br>422968 | [hu anti-<huGLP-1R><br>3E6.1 (Q46(39)K)<br>VH]::huIgG1z-SEFL2-<br>KDD + gila<br>monsterExendin-4(1-<br>22)::1AQ1K(modV, GS):<br>:[hu anti-<huGLP-1R><br>3E6 (Q46(112)E,<br>C105S) VL]::huKLC-<br>S176E + [anti-<br><huGIPR> 5G12.005<br>(Q46E)VH]::huIgG1z-<br>SEFL2-EKK + [hu anti-<br><huGIPR> 21-<br>143_5G12.006 VK1<br>(Q46(38)K, C137(118)I)<br>VL]::huKLC-S176K<br>(Hetero-Ig) | QVQLVESGGGVVQPGRSLRLSCAASGFTLSSYGMHWVRKAPGKGLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3426) |
| PL-47272 | iPS:<br>422969 | [hu anti-<huGLP-1R><br>3E6.1 (G51(44)K)<br>VH]::huIgG1z-SEFL2-<br>KDD + gila | QVQLVESGGGVVQPGRSLRLSCAASGFTLSSYGMHWVRQAPGKKLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS |

TABLE 8-continued

| anti-GIPR antibodies and GLP-1/anti-GIPR antibody fusion polypeptides | | | |
|---|---|---|---|
| | | monsterExendin-4(1-22)::1AQ1K(modV, GS)::[hu anti-<huGLP-1R> 3E6 (C105S, Q141(174)E) VL]::huKLC-S176E + [anti-<huGIPR> 5G12.005 (Q51G) VH]::huIgG1z-SEFL2-EKK + [hu anti-<huGIPR> 21-143_5G12.006 VK1 (Q141(100)K, C137(118)I) VL]::huKLC-S176K (Hetero-Ig) | SLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 3427) |
| PL-47273 | iPS: 422970 | [hu anti-<huGLP-1R> 3E6.1 VH]::huIgG1z-SEFL2-KDD + gila monsterExendin-4(1-22)::1AQ1K(modV, GS)::[hu anti-<huGLP-1R> 3E6VL]::huKLC-S176E + [anti-<huGIPR> 21-143_6H1 VH3 VH]::huIgG1z-SEFL2-EKK + [hu anti-<huGIPR> 21-143_6H1 VK1VL]::huKLC-S176K (Hetero-Ig) | QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 3428) |
| PL-47274 | iPS: 422971 | [hu anti-<huGLP-1R> 3E6.1 (Q46(39)K) VH]::huIgG1z-SEFL2-KDD + gila monsterExendin-4(1-22)::1AQ1K(modV, GS)::[hu anti-<huGLP-1R> 3E6 (Q46(112)E) VL]::huKLC-S176E + [anti-<huGIPR> 21-143_6H1 VH3 (Q46E) VH]::huIgG1z-SEFL2-EKK + [hu anti-<huGIPR> 21-143_6H1 VK1 (Q46(38)K) VL]::huKLC-S176K (Hetero-Ig) | QVQLVESGGGVVQPGRSLRLSCAASGFTLSSYGMHWVRKAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 3429) |
| PL-47275 | iPS: 422972 | [hu anti-<huGLP-1R> 3E6.1 (G51(44)K) VH]::huIgG1z-SEFL2-KDD + gila monsterExendin-4(1-22)::1AQ1K(modV, GS)::[hu anti-<huGLP-1R> 3E6 (Q141(174)E) VL]::huKLC-S176E + [anti-<huGIPR> 21-143_6H1 VH3 (G51E) VH]::huIgG1z-SEFL2-EKK + [hu anti-<huGIPR> 21-143_6H1 VK1 (P141(100)K) VL]::huKLC-S176K (Hetero-Ig) | QVQLVESGGGVVQPGRSLRLSCAASGFTLSSYGMHWVRQAPGKKLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 3430) |
| PL-47276 | iPS: 422973 | [hu anti-<huGLP-1R> 3E6.1 VH]::huIgG1z-SEFL2-KDD + gila monsterExendin-4(1-22)::1AQ1K(modV, GS)::[hu anti-<huGLP-1R> 3E6 (C105Y) VL]::huKLC-S176E + [anti-<huGIPR> 21-143_6H1 VH3 | QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK (SEQ ID NO: 3431) |

TABLE 8-continued anti-GIPR antibodies and GLP-1/anti-GIPR antibody fusion polypeptides

| | | | |
|---|---|---|---|
| | | VH]::huIgG1z-SEFL2-EKK + [hu anti-<huGIPR> 21-143_6H1 VK1VL]::huKLC-S176K (Hetero-Ig) | |
| PL-47277 | iPS: 422974 | [hu anti-<huGLP-1R> 3E6.1 (Q46(39)K) VH]::huIgG1z-SEFL2-KDD + gila monsterExendin-4(1-22)::1AQ1K(modV, GS)::[hu anti-<huGLP-1R> 3E6 (Q46(112)E, C105Y) VL]::huKLC-S176E + [anti-<huGIPR> 21-143_6H1 VH3 (Q46E) VH]::huIgG1z-SEFL2-EKK + [hu anti-<huGIPR> 21-143_6H1 VK1 (Q46(38)K) VL]::huKLC-S176K (Hetero-Ig) | QVQLVESGGGVVQPGRSLRLSCAASGFTLSSYGMHWVRKAPGKGLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3432) |
| PL-47278 | iPS: 422975 | [hu anti-<huGLP-1R> 3E6.1 (G51(44)K) VH]::huIgG1z-SEFL2-KDD + gila monsterExendin-4(1-22)::1AQ1K(modV, GS)::[hu anti-<huGLP-1R> 3E6 (C105Y, Q141(174)E) VL]::huKLC-S176E + [anti-<huGIPR> 21-143_6H1 VH3 (G51E) VH]::huIgG1z-SEFL2-EKK + [hu anti-<huGIPR> 21-143_6H1 VK1 (P141(100)K) VL]::huKLC-S176K (Hetero-Ig) | QVQLVESGGGVVQPGRSLRLSCAASGFTLSSYGMHWVRQAPGKKLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3433) |
| PL-47279 | iPS: 422976 | [hu anti-<huGLP-1R> 3E6.1 VH]::huIgG1z-SEFL2-KDD + gila monsterExendin-4(1-22)::1AQ1K(modV, GS)::[hu anti-<huGLP-1R> 3E6 (C105S) VL]::huKLC-S176E + [anti-<huGIPR> 21-143_6H1 VH3 VH]::huIgG1z-SEFL2-EKK + [hu anti-<huGIPR> 21-143_6H1 VK1 VL]::huKLC-S176K (Hetero-Ig) | QVQLVESGGGVVQPGRSLRLSCAASGFTLSSYGMHWVRQAPGKGLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3434) |
| PL-47280 | iPS: 422977 | [hu anti-<huGLP-1R> 3E6.1 (Q46(39)K) VH]::huIgG1z-SEFL2-KDD + gila monsterExendin-4(1-22)::1AQ1K(modV, GS)::[hu anti-<huGLP-1R> 3E6 (Q46(112)E, C105S) VL]::huKLC-S176E + [anti-<huGIPR> 21-143_6H1 VH3 (Q46E) VH]::huIgG1z-SEFL2-EKK + [hu anti-<huGIPR> 21-143_6H1 VK1 (Q46(38)K) VL]::huKLC-S176K (Hetero-Ig) | QVQLVESGGGVVQPGRSLRLSCAASGFTLSSYGMHWVRKAPGKGLEWVA<br>VIWYDGSNKYYADSVKGRFTISRDNSKNTLYLQMNSLRAEDTAVYYCAR<br>GGGSGSYRYYYYGLDVWGQGTTVTVSSASTKGPSVFPLAPSSKSTSGGTA<br>ALGCLVKDYFPEPVTVSWNSGALTSGVHTFPAVLQSSGLYSLKSVVTVPSS<br>SLGTQTYICNVNHKPSNTKVDKKVEPKSCDKTHTCPPCPAPELLGGPSVFLF<br>PPKPKDTLMISRTPEVTCVVVDVSHEDPEVKFNWYVDGVEVHNAKTKPCE<br>EQYGSTYRCVSVLTVLHQDWLNGKEYKCKVSNKALPAPIEKTISKAKGQP<br>REPQVYTLPPSREEMTKNQVSLTCLVKGFYPSDIAVEWESNGQPENNYDTT<br>PPVLDSDGSFFLYSDLTVDKSRWQQGNVFSCSVMHEALHNHYTQKSLSLS<br>PGK (SEQ ID NO: 3435) |

TABLE 8-continued

| anti-GIPR antibodies and GLP-1/anti-GIPR antibody fusion polypeptides | | | |
|---|---|---|---|
| PL-47281 | iPS: 422978 | [hu anti-<huGLP-1R> 3E6.1 (G51(44)K) VH]::huIgG1z-SEFL2-KDD + gila monsterExendin-4(1-22)::1AQ1K(modV, GS)::[hu anti-<huGLP-1R> 3E6 (C105S, Q141(174)E) VL]::huKLC-S176E + [anti-<huGIPR> 21-143_6H1 VH3 (G51E) VH]::huIgG1z-SEFL2-EKK + [hu anti-<huGIPR> 21-143_6H1 VK1 (P141(100)K) VL]::huKLC-5176K (Hetero-Ig) | QVQLVESGGGVVQPGRSLRLSCAAS GFTLSSYGMHWVRQAPGKKLEWVA VIWYDGSNKYYADSVKGRFTISRDN SKNTLYLQMNSLRAEDTAVYYCAR GGGSGSYRYYYYGLDVWGQGTTVT VSSASTKGPSVFPLAPSSKSTSGGTA ALGCLVKDYFPEPVTVSWNSGALTS GVHTFPAVLQSSGLYSLKSVVTVPSS SLGTQTYICNVNHKPSNTKVDKKVE PKSCDKTHTCPPCPAPELLGGPSVFL FPPKPKDTLMISRTPEVTCVVVDVSH EDPEVKFNWYVDGVEVHNAKTKPC EEQYGSTYRCVSVLTVLHQDWLNG KEYKCKVSNKALPAPIEKTISKAKGQ PREPQVYTLPPSREEMTKNQVSLTCL VKGFYPSDIAVEWESNGQPENNYDT TPPVLDSDGSFFLYSDLTVDKSRWQ QGNVFSCSVMHEALHNHYTQKSLSL SPGK (SEQ ID NO: 3436) |
| PL-46633 | iPS: 424468 | [hu anti-<huGIPR> 21-143_2G10_LC1 VK3 (1-236) VL]::huKLC-S176K + [hu anti-<huGIPR> 21-143_2G10_LC1.003 VH3 (1-472)(573(85)A, G65(77)A) VH]::huIgG1z-SEFL2-EKK + gila monsterExendin-4(1-22)::1AQ1K(modV, GS)::[hu anti-<huGLP-1R> 3E6 VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3437) |
| PL-46634 | iPS: 424470 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)::1AQ1K(modV, GS)::[hu anti-<huGLP-1R> 3E6 (C105Y) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3438) |
| PL-46635 | iPS: 424471 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)::1AQ1K(modV, GS)::[hu anti-<huGLP-1R> 3E6 (C105S) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3439) |
| PL-46636 | iPS: 424473 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(G2S)::1AQ1K(modV, GS)::[hu anti-<huGLP-1R> 3E6 (C105Y) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3440) |
| PL-46637 | iPS: 424474 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila | EIVMTQSPATLSVSPGE RATLSCRASQSVSSNL AWYQQKPGQAPRLLIY GAATRATGIPARVSGS GSGTEFTLTISSLQSED |

TABLE 8-continued

| anti-GIPR antibodies and GLP-1/anti-GIPR antibody fusion polypeptides | | | |
|---|---|---|---|
| | | monsterExendin-4(1-22)(G2S, E3Q)::1AQ1K(modV, GS)::[hu anti-<huGLP-1R> 3E6 (C105Y) VL]::huKLC-S176E + [hu anti-<huGLP-1R> 3E6.1 VH]::huIgG1z-SEFL2-KDD (Hetero-Ig) | FAVYYCQQYNNWPLT FGGGTKVEIKR (SEQ ID NO: 3441) |
| PL-46638 | iSP: 424476 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(E3D)::1AQ1K(modV, GS)::[hu anti-<huGLP-1R> 3E6 (C105Y) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3442) |
| PL-46639 | iPS: 424477 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(G2S, E3D)::1AQ1K(modV, GS)::[hu anti-<huGLP-1R> 3E6 (C105Y) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3443) |
| PL-46640 | iPS: 424479 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(G2S)::1AQ1K(modV, GS)::[hu anti-<huGLP-1R> 3E6 (C105S) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3444) |
| PL-46641 | iPS: 424480 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(G2S, E3Q)::1AQ1K(modV, GS)::[hu anti-<huGLP-1R> 3E6 (C105S) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3445) |
| PL-46642 | iPS: 424482 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(E3D)::1AQ1K(modV, GS)::[hu anti-<huGLP-1R> 3E6 (C105S) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3446) |
| PL-46643 | iPS: 424483 | [hu anti-<huGIPR> 21-143_2G10_LC1 VK3 (1-236) VL]::huKLC-S176K + [hu anti-<huGIPR> 21-143_2G10_LC1.003 VH3 (1-472)(S73(85)A, G65(77)A) VH]::huIgG1z-SEFL2-EKK + gila monsterExendin-4(1-22)(G2S, E3D)::1AQ1K(modV, GS)::[hu anti-<huGLP-1R> 3E6 (C105S) VL]::huKLC-S176E + [hu anti-<huGLP-1R> 3E6.1 VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGGGTKVEIKR (SEQ ID NO: 3447) |

TABLE 8-continued anti-GIPR antibodies and GLP-1/anti-GIPR antibody fusion polypeptides

| | | | |
|---|---|---|---|
| PL-46644 | iPS: 424485 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)::1AQ1K(modV, GS)::[hu anti-<huGLP-1R> 3E6 (Q46(112)E) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3448) |
| PL-46645 | iPS: 424486 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)::1AQ1K(modV, GS)::[hu anti-<huGLP-1R> 3E6 (Q46(112)E, C105Y) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3449) |
| PL-46646 | iPS: 424487 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)::1AQ1K(modV, GS)::[hu anti-<huGLP-1R> 3E6 (Q46(112)E, C105S) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3450) |
| PL-46647 | iPS: 424488 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G25)::1AQ1K(modV, GS)::[hu anti-<huGLP-1R> 3E6 (C105Y, Q46E) VL]::huKLC-5176E + [hu anti-<huGLP-1R> 3E6.1 (Q46(39)K) VH]::huIgG1z-SEFL2-KDD (Hetero-Ig) | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3451) |
| PL-46648 | iPS: 424489 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G2S, E3Q)::1AQ1K(modV, GS)::[hu anti-<huGLP-1R> 3E6 (C105Y, Q46E) VL]::huKLC-S176E + [hu anti- | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQE |

TABLE 8-continued

| anti-GIPR antibodies and GLP-1/anti-GIPR antibody fusion polypeptides | | | |
|---|---|---|---|
| | | <huGLP-1R> 3E6.1 (Q46(39)K) VH]::huIgG1z-SEFL2-KDD (Hetero-Ig) | SVTEQDSKDSTYSLKS TLTLSKADYEKHKVY ACEVTHQGLSSPVTKS FNRGEC (SEQ ID NO: 3452) |
| PL-46649 | iPS: 424490 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(E3D)::1AQ1K(modV, GS)::[hu anti-<huGLP-1R> 3E6 (C105Y, Q46E) VL]::huKLC-5176E + [hu anti-<huGLP-1R> 3E6.1 (Q46(39)K) VH]::huIgG1z-SEFL2-KDD (Hetero-Ig) | EIVMTQSPATLSVSPGE RATLSCRASQSVSSNL AWYQKKPGQAPRLLIY GAATRATGIPARVSGS GSGTEFTLTISSLQSED FAVYYCQQYNNWPLT FGGGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3453) |
| PL-46650 | iPS: 424491 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G2S, E3D)::1AQ1K(modV, GS)::[hu anti-<huGLP-1R> 3E6 (C105Y, Q46E) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGE RATLSCRASQSVSSNL AWYQKKPGQAPRLLIY GAATRATGIPARVSGS GSGTEFTLTISSLQSED FAVYYCQQYNNWPLT FGGGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3454) |
| PL-46651 | iPS: 424492 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G2S)::1AQ1K(modV, GS)::[hu anti-<huGLP-1R> 3E6 (C105S, Q46E) VL]::huKLC-5176E + [hu anti-<huGLP-1R> 3E6.1 (Q46(39)K) VH]::huIgG1z-SEFL2-KDD (Hetero-Ig) | EIVMTQSPATLSVSPGE RATLSCRASQSVSSNL AWYQKKPGQAPRLLIY GAATRATGIPARVSGS GSGTEFTLTISSLQSED FAVYYCQQYNNWPLT FGGGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3455) |
| PL-46652 | iPS: 424493 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G2S, E3Q)::1AQ1K(modV, GS)::[hu anti-<huGLP-1R> 3E6 (C105S, Q46E) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGE RATLSCRASQSVSSNL AWYQKKPGQAPRLLIY GAATRATGIPARVSGS GSGTEFTLTISSLQSED FAVYYCQQYNNWPLT FGGGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3456) |
| PL-46653 | iPS: 424494 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(E3D)::1AQ1K(modV, GS)::[hu anti-<huGLP-1R> 3E6 (C105S, Q46E) VL]::huKLC-5176E + [hu anti-<huGLP-1R> 3E6.1 (Q46(39)K) | EIVMTQSPATLSVSPGE RATLSCRASQSVSSNL AWYQKKPGQAPRLLIY GAATRATGIPARVSGS GSGTEFTLTISSLQSED FAVYYCQQYNNWPLT FGGGTKVEIKRTVAAP SVFIFPPSDEQLKSGTA SVVCLLNNFYPREAKV QWKVDNALQSGNSQE SVTEQDSKDSTYSLKS |

TABLE 8-continued

| anti-GIPR antibodies and GLP-1/anti-GIPR antibody fusion polypeptides | | | |
|---|---|---|---|
| | | VH]::huIgG1z-SEFL2-KDD (Hetero-Ig) | TLTLSKADYEKHKVYACEVTHQGLSSPVTKSFNRGEC (SEQ ID NO: 3457) |
| PL-46654 | iPS: 424495 | [hu anti-<huGIPR> 21-143_2G10_LC1 VK3 (1-236)(Q46(38)K) VL]::huKLC-S176K + [hu anti-<huGIPR> 21-143_2G10_LC1.003 VH3 (1-472)(Q46(38)E, S73(85)A, G65(77)A) VH]::huIgG1z-SEFL2-EKK + gila monsterExendin-4(1-22)(G2S, E3D)::1AQ1K(modV, GS)::[hu anti-<huGLP-1R> 3E6 (C105S, Q46E) VL]::huKLC-S176E + [hu anti-<huGLP-1R> 3E6.1 (Q46(39)K) VH]::huIgG1z-SEFL2-KDD (Hetero-Ig) | EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3458) |
| PL-46655 | iPS: 424496 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)::1AQ1K(modV, GS)::[hu anti-<huGLP-1R> 3E6 (Q141(174)E) VL]::huKLC-5176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3459) |
| PL-46656 | iPS: 424497 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)::1AQ1K(modV, GS)::[hu anti-<huGLP-1R> 3E6 (C105Y, Q141(174)E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3460) |
| PL-46657 | iPS: 424498 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)::1AQ1K(modV, GS)::[hu anti-<huGLP-1R> 3E6 (C105S, Q141(174)E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3461) |
| PL-46658 | iPS: 424499 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S)::1AQ1K(modV, GS)::[hu anti-<huGLP-1R> 3E6 (C105Y, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3462) |

TABLE 8-continued

| anti-GIPR antibodies and GLP-1/anti-GIPR antibody fusion polypeptides | | |
|---|---|---|
| PL-46659 iSP: 424500 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S, E3Q)::1AQ1K(modV, GS)::[hu anti-<huGLP-1R> 3E6 (C105Y, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGKGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3463) |
| PL-46660 iPS: 424501 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(E3D)::1AQ1K(modV, GS)::[hu anti-<huGLP-1R> 3E6 (C105Y, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGKGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3464) |
| PL-46661 iPS: 424502 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S, E3D)::1AQ1K(modV, GS)::[hu anti-<huGLP-1R> 3E6 (C105Y, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGKGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3465) |
| PL-46662 iPS: 424503 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S)::1AQ1K(modV, GS)::[hu anti-<huGLP-1R> 3E6 (C105S, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGKGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3466) |
| PL-46663 iPS: 424504 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S, E3Q)::1AQ1K(modV, GS)::[hu anti-<huGLP-1R> 3E6 (C105S, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGE RATLSCRASQSVSSNL AWYQQKPGQAPRLLIY GAATRATGIPARVSGS GSGTEFTLTISSLQSED FAVYYCQQYNNWPLT FGKGTKVEIKRTVAAP SVFIFPPSDEQLKSGTA SVVCLLNNFYPREAKV QWKVDNALQSGNSQE SVTEQDSKDSTYSLKS TLTLSKADYEKHKVY ACEVTHQGLSSPVTKS FNRGEC (SEQ ID NO: 3467) |

TABLE 8-continued

| anti-GIPR antibodies and GLP-1/anti-GIPR antibody fusion polypeptides | | | |
|---|---|---|---|
| PL-46664 | iPS: 424505 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(E3D)::1AQ1K(modV, GS)::[hu anti-<huGLP-1R> 3E6 (C105S, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3468) |
| PL-46665 | iPS: 424506 | [hu anti-<huGIPR> 21-143_2G10_LC1 VK3 (1-236)(P141(100)K) VL]::huKLC-S176K + [hu anti-<huGIPR> 21-143_2G10_LC1.003 VH3 (1-472)(G51(44)E, S73(85)A, G65(77)A)VH]::huIgG1z-SEFL2-EKK + gila monsterExendin-4(1-22)(G2S, E3D)::1AQ1K(modV, GS)::[hu anti-<huGLP-1R> 3E6 (C105S, Q141E) VL]::huKLC-S176E + [hu anti-<huGLP-1R> 3E6.1 (G51(44)K) VH]::huIgG1z-SEFL2-KDD (Hetero-Ig) | EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC (SEQ ID NO: 3469) |
| PL-47505 | iPS: 427374 | [anti-<huGIPR> 21-143_2G10_LC1.007 VH3 (1-472)(S73(85)A, E50(65)K, G65(77)A) VH]::huIgG1zSEFL2-2E384C + [Unknown anti-<huGIPR> 21-143_2G10_LC1.007 VK3 (1-236)(Q97(101)E, V78(84)F, S98(102)P, W135(116)F) VL]::huKLC-CL (mAb) | QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3470) |
| PL-47368 | iPS: 428006 | huGLP-1(A2S, G16E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3471) |
| PL-47369 | iPS: 428007 | huGLP-1(A2S, E3Q, G16E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3472) |
| PL-47370 | iPS: 428008 | huGLP-1(A2G, E3D, G16E, R30G)::1KmodT482V, M493L)::[hu anti-<huGIPR> 21-143_6H1 VH3 | HGDGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPP |

TABLE 8-continued

| anti-GIPR antibodies and GLP-1/anti-GIPR antibody fusion polypeptides | | | |
|---|---|---|---|
| | | VH]::huIgG1zSEFL2-2 + [Unknown anti-<huGIPR> 21-143_4B1 VK1 (1-236) VL]::huKLC-CL (Pepti-HC) | KPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3473) |
| PL-47371 | iPS: 428009 | huGLP-1(A2S, E3D, G16E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3474) |
| PL-47372 | iPS: 428011 | huGLP-1(A2G, G16E, A24E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3475) |
| PL-47373 | iPS: 428012 | huGLP-1(A2S, G16E, A24E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3476) |
| PL-47374 | iPS: 428013 | huGLP-1(A2S, E3Q, G16E, A24E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3477) |
| PL-47375 | iPS: 428014 | huGLP-1(A2G, E3D, G16E, A24E, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3478) |
| PL-47376 | iPS: 428015 | huGLP-1(A2S, E3D, G16E, A24E, R30G)::1KmodT482V, M493L)::[anti-<huGIPR> 21-143_6H1 VH3 | HSDGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPP |

TABLE 8-continued

| anti-GIPR antibodies and GLP-1/anti-GIPR antibody fusion polypeptides | | | |
|---|---|---|---|
| | | VH]::huIgG1zSEFL2-2 + [Unknown anti-<huGIPR> 21-143_4B1 VK1 (1-236) VL]::huKLC-CL (Pepti-HC) | KPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3479) |
| PL-47377 | iPS: 428016 | huGLP-1(A2G, G16E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3480) |
| PL-47378 | iPS: 428017 | huGLP-1(A2S, G16E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3481) |
| PL-47379 | iPS: 428018 | huGLP-1(A2S, E3Q, G16E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3482) |
| PL-47380 | iPS: 428019 | huGLP-1(A2G, E3D, G16E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3483) |
| PL-47381 | iPS: 428020 | huGLP-1(A2S, E3D, G16E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3484) |
| PL-47382 | iPS: 428021 | huGLP-1(A2G, G16E, A24E, V27K, K28N, R30G)::1KmodT482V, M493L)::[hu anti-<huGIPR> 21-143_6H1 VH3 | HGEGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPP |

TABLE 8-continued anti-GIPR antibodies and GLP-1/anti-GIPR antibody fusion polypeptides

| | | | |
|---|---|---|---|
| | | VH]::huIgG1zSEFL2-2 + [Unknown anti-<huGIPR> 21-143_4B1 VK1 (1-236) VL]::huKLC-CL (Pepti-HC) | KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3485) |
| PL-47383 | iPS: 428022 | huGLP-1(A2S, G16E, A24E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGSGSATGGSGSVASSGSGSA THLQVQLVESGGGVVQPGRSLRLSCAASGFTFSYFGMHWVRQAPGKGLE WVAVIWYDGSNKYYADSVKGRFTISRDNSKNTLYLQMNSLRAEDTAVYY CARDGTIFGVLLGDYWGQGTLVTVSSASTKGPSVFPLAPSSKSTSGGTAAL GCLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLFPP KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3486) |
| PL-48488 | iPS: 428022 | huGLP-1(A2S, G16E, A24E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGSGSATGGSGSVASSGSGSA THLQVQLVESGGGVVQPGRSLRLSCAASGFTFSYFGMHWVRQAPGKGLE WVAVIWYDGSNKYYADSVKGRFTISRDNSKNTLYLQMNSLRAEDTAVYY CARDGTIFGVLLGDYWGQGTLVTVSSASTKGPSVFPLAPSSKSTSGGTAAL GCLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLFPP KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3487) |
| PL-47384 | iPS: 428023 | huGLP-1(A2S, E3Q, G16E, A24E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIEWLKNGGGGSGSATGGSGSVASSGSGSA THLQVQLVESGGGVVQPGRSLRLSCAASGFTFSYFGMHWVRQAPGKGLE WVAVIWYDGSNKYYADSVKGRFTISRDNSKNTLYLQMNSLRAEDTAVYY CARDGTIFGVLLGDYWGQGTLVTVSSASTKGPSVFPLAPSSKSTSGGTAAL GCLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLFPP KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3488) |
| PL-47385 | iSP: 428024 | huGLP-1(A2G, E3D, G16E, A24E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIEWLKNGGGGSGSATGGSGSVASSGSGSA THLQVQLVESGGGVVQPGRSLRLSCAASGFTFSYFGMHWVRQAPGKGLE WVAVIWYDGSNKYYADSVKGRFTISRDNSKNTLYLQMNSLRAEDTAVYY CARDGTIFGVLLGDYWGQGTLVTVSSASTKGPSVFPLAPSSKSTSGGTAAL GCLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLFPP KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3489) |
| PL-47386 | iPS: 428025 | huGLP-1(A2S, E3D, G16E, A24E, V27K, K28N, R30G)::1KmodT482V, M493L)::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIEWLKNGGGGSGSATGGSGSVASSGSGSA THLQVQLVESGGGVVQPGRSLRLSCAASGFTFSYFGMHWVRQAPGKGLE WVAVIWYDGSNKYYADSVKGRFTISRDNSKNTLYLQMNSLRAEDTAVYY CARDGTIFGVLLGDYWGQGTLVTVSSASTKGPSVFPLAPSSKSTSGGTAAL GCLVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFLFPP KPKDTLMISRTPEVTCVVVDVSHEDPEVKFNWYVDGVEVHNAKTKPCEEQ YGSTYRCVSVLTVLHQDWLNGKEYKCKVSNKALPAPIEKTISKAKGQPRE PQVYTLPPSREEMTKNQVSLTCLVKGFYPSDIAVEWESNGQPENNYKTTPP VLDSDGSFFLYSKLTVDKSRWQQGNVFSCSVMHEALHNHYTQKSLSLSPG K (SEQ ID NO: 3490) |
| PL-47387 | iPS: 428026 | huGLP-1(A2G, G16E, R30G)::(G4A)3::G4::[hu anti-<huGIPR> 21- | HGEGTFTSDVSSYLEEQAAKEFIAWLVKGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA |

TABLE 8-continued

| anti-GIPR antibodies and GLP-1/anti-GIPR antibody fusion polypeptides | | | |
|---|---|---|---|
| | | 143_6H1 VH3 VH]::huIgG1zSEFL2-2 + [Unknown anti-<huGIPR> 21-143_4B1 VK1 (1-236) VL]::huKLC-CL (Pepti-HC) | RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3491) |
| PL-47388 | iPS: 428028 | huGLP-1(A2S, G16E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLVKGGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3492) |
| PL-47389 | iPS: 428029 | huGLP-1(A2S, E3Q, G16E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLVKGGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3493) |
| PL-47390 | iPS: 428030 | huGLP-1(A2G, E3D, G16E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIAWLVKGGGGGGGAGGGGAGGGGAGG<br>GGQVQLVESGGGVVQPGRSLRLSCAASGFTFSYFGMHWVRQAPGKGLEW<br>VAVIWYDGSNKYYADSVKGRFTISRDNSKNTLYLQMNSLRAEDTAVYYC<br>ARDGTIFGVLLGDYWGQGTLVTVSSASTKGPSVFPLAPSSKSTSGGTAALG<br>CLVKDYFPEPVTVSWNSGALTSGVHIFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3494) |
| PL-47391 | iPS: 428031 | huGLP-1(A2S, E3D, G16E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIAWLVKGGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3495) |
| PL-47392 | iPS: 428032 | huGLP-1(A2G, G16E, A24E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIEWLVKGGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3496) |
| PL-47393 | iPS: 428033 | huGLP-1(A2S, G16E, A24E, R30G)::(G4A)3::G4::[hu anti-<huGIPR> 21-143_6H1 VH3 VH]::huIgG1zSEFL2-2 + | HSEGTFTSDVSSYLEEQAAKEFIEWLVKGGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP |

TABLE 8-continued

| anti-GIPR antibodies and GLP-1/anti-GIPR antibody fusion polypeptides | | | |
|---|---|---|---|
| | | [Unknown anti-<huGIPR> 21-143_4B1 VK1 (1-236) VL]::huKLC-CL (Pepti-HC) | KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3497) |
| PL-47394 | iPS: 428034 | huGLP-1(A2S, E3Q, G16E, A24E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIEWLVKGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3498) |
| PL-47395 | iPS: 428035 | huGLP-1(A2G, E3D, G16E, A24E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIEWLVKGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3499) |
| PL-47396 | iPS: 428036 | huGLP-1(A2S, E3D, G16E, A24E, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIEWLVKGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3500) |
| PL-47397 | iPS: 428037 | huGLP-1(A2G, G16E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIAWLKNGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3501) |
| PL-47398 | iPS: 428038 | huGLP-1(A2S, G16E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLKNGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3502) |
| PL-47399 | iPS: 428039 | huGLP-1(A2S, E3Q, G16E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLKNGGGGGGGAGGGGAGGGGAGGG GQVQLVESGGGVVQPGRSLRLSCAASGFTFSYFGMHWVRQAPGKGLEWV AVIWYDGSNKYYADSVKGRFTISRDNSKNTLYLQMNSLRAEDTAVYYCA RDGTIFGVLLGDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTVPV LDSDGSFFLYSKLTVDKSRWQQGNVFSCSVMHEALHNHYTQKSLSLSPGK (SEQ ID NO: 3503) |

TABLE 8-continued

| anti-GIPR antibodies and GLP-1/anti-GIPR antibody fusion polypeptides | | | |
|---|---|---|---|
| PL-47400 | iPS: 428040 | huGLP-1(A2G, E3D, G16E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIAWLKNGGGGGGAGGGGAGGGGAGG<br>GGQVQLVESGGGVVQPGRSLRLSCAASGFTFSYFGMHWVRQAPGKGLEW<br>VAVIWYDGSNKYYADSVKGRFTISRDNSKNTLYLQMNSLRAEDTAVYYC<br>ARDGTIFGVLLGDYWGQGTLVTVSSASTKGPSVFPLAPSSKSTSGGTAALG<br>CLVKDYFPEPVTVSWNSGALTSGVHIFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3504) |
| PL-47401 | iPS: 428041 | huGLP-1(A2S, E3D, G16E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIAWLKNGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3505) |
| PL-47402 | iPS: 428042 | huGLP-1(A2G, G16E, A24E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIEWLKNGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3506) |
| PL-47403 | iPS: 428043 | huGLP-1(A2S, G16E, A24E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3507) |
| PL-48489 | iPS: 428043 | huGLP-1(A2S, G16E, A24E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKTTVPV<br>LDSDGSFFLYSKLTVDKSRWQQGNVFSCSVMHEALHNHYTQKSLSLSPGK<br>(SEQ ID NO: 3508) |
| PL-47404 | iPS: 428044 | huGLP-1(A2S, E3Q, G16E, A24E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIEWLKNGGGGGGAGGGGAGGGGAGGG<br>GQVQLVESGGGVVQPGRSLRLSCAASGFTFSYFGMHWVRQAPGKGLEWV<br>AVIWYDGSNKYYADSVKGRFTISRDNSKNTLYLQMNSLRAEDTAVYYCA<br>RDGTIFGVLLGDYWGQGTLVTVSSASTKGPSVFPLAPSSKSTSGGTAALGC<br>LVKDYFPEPVTVSWNSGALTSGVHTFPAVLQSSGLYSLSSVVTVPSSSLGT<br>QTYICNVNHKPSNTKVDKKVEPKSCDKTHTCPPCPAPELLGGPSVFLFPPKP<br>KDTLMISRTPEVTCVVVDVSHEDPEVKFNWYVDGVEVHNAKTKPCEEQY<br>GSTYRCVSVLTVLHQDWLNGKEYKCKVSNKALPAPIEKTISKAKGQPREP<br>QVYTLPPSREEMTKNQVSLTCLVKGFYPSDIAVEWESNGQPENNYKFLPPV<br>LDSDGSFFLYSKLTVDKSRWQQGNVFSCSVMHEALHNHYTQKSLSLSPGK<br>(SEQ ID NO: 3509) |
| PL-47405 | iPS: 428045 | huGLP-1(A2G, E3D, G16E, A24E, V27K, K28N, R30G)::(G4A)3::G4::[hu anti-<huGIPR> 21- | HGDGTFTSDVSSYLEEQAAKEFIEWLKNGGGGGGAGGGGAG<br>GGGAGGGGQVQLVESGGGVVQPGRSLRLSCAASGFTFSYFGM<br>HWVRQAPGKGLEWVAVIWYDGSNKYYADSVKGRFTISRDNS<br>KNTLYLQMNSLRAEDTAVYYCARDGTIFGVLLGDYWGQGTLV<br>TVSSASTKGPSVFPLAPSSKSTSGGTAALGCLVKDYFPEPVTVS |

TABLE 8-continued anti-GIPR antibodies and GLP-1/anti-GIPR antibody fusion polypeptides

| | | | |
|---|---|---|---|
| | | 143_6H1 VH3 VH]::huIgG1zSEFL2-2 + [Unknown anti-<huGIPR> 21-143_4B1 VK1 (1-236) VL]::huKLC-CL (Pepti-HC) | WNSGALTSGVHIFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3510) |
| PL-47406 | iPS: 428046 | huGLP-1(A2S, E3D, G16E, A24E, V27K, K28N, R30G)::(G4A)3::G4::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIEWLKNGGGGGGGAGGGGAGGGGAGGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3511) |
| PL-47407 | iPS: 428047 | huGLP-1(A2G, G16E, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIAWLVKGGGGAPAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3512) |
| PL-47408 | iPS: 428048 | huGLP-1(A2S, G16E, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLVKGGGGAPAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3513) |
| PL-47409 | iPS: 428049 | huGLP-1(A2S, E3Q, G16E, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLVKGGGGAPAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3514) |
| PL-47410 | iSP: 428050 | huGLP-1(A2G, E3D, G16E, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIAWLVKGGGGAPAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3515) |

TABLE 8-continued

| anti-GIPR antibodies and GLP-1/anti-GIPR antibody fusion polypeptides | | | |
|---|---|---|---|
| PL-47411 | iPS:<br>428051 | huGLP-1(A2S, E3D,<br>G16E,<br>R30G)::G::(AP)10::G::[hu<br>anti-<huGIPR> 21-<br>143_6H1 VH3<br>VH]::huIgG1zSEFL2-2 +<br>[Unknown anti-<br><huGIPR> 21-143_4B1<br>VK1 (1-236)<br>VL]::huKLC-CL (Pepti-<br>HC) | HSDGTFTSDVSSYLEEQAAKEFIAWLVKGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3516) |
| PL-47412 | iPS:<br>428052 | huGLP-1(A2G, G16E,<br>A24E,<br>R30G)::G::(AP)10::G::[hu<br>anti-<huGIPR> 21-<br>143_6H1 VH3<br>VH]::huIgG1zSEFL2-2 +<br>[Unknown anti-<br><huGIPR> 21-143_4B1<br>VK1 (1-236)<br>VL]::huKLC-CL (Pepti-<br>HC) | HGEGTFTSDVSSYLEEQAAKEFIEWLVKGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3517) |
| PL-47413 | iSP:<br>428053 | huGLP-1(A2S, G16E,<br>A24E,<br>R30G)::G::(AP)10::G::[hu<br>anti-<huGIPR> 21-<br>143_6H1 VH3<br>VH]::huIgG1zSEFL2-2 +<br>[Unknown anti-<br><huGIPR> 21-143_4B1<br>VK1 (1-236)<br>VL]::huKLC-CL (Pepti-<br>HC) | HSEGTFTSDVSSYLEEQAAKEFIEWLVKGGGGAPAPAPAPAPAP<br>APAPAPAPGQVQLVESGGGVVQPGRSLRLSCAASGFTFSYFGM<br>HWVRQAPGKGLEWVAVIWYDGSNKYYADSVKGRFTISRDNS<br>KNTLYLQMNSLRAEDTAVYYCARDGTIFGVLLGDYWGQGTLV<br>TVSSASTKGPSVFPLAPSSKSTSGGTAALGCLVKDYFPEPVTVS<br>WNSGALTSGVHTFPAVLQSSGLYSLSSVVTVPSSSLGTQTYICN<br>VNHKPSNTKVDKKVEPKSCDKTHTCPPCPAPELLGGPSVFLFPP<br>KPKDTLMISRTPEVTCVVVDVSHEDPEVKFNWYVDGVEVHNA<br>KTKPCEEQYGSTYRCVSVLTVLHQDWLNGKEYKCKVSNKALP<br>APIEKTISKAKGQPREPQVYTLPPSREEMTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK<br>(SEQ ID NO: 3518) |
| PL-47414 | iPS:<br>428054 | huGLP-1(A2S, E3Q,<br>G16E, A24E,<br>R30G)::G::(AP)10::G::[hu<br>anti-<huGIPR> 21-<br>143_6H1 VH3<br>VH]::huIgG1zSEFL2-2 +<br>[Unknown anti-<br><huGIPR> 21-143_4B1<br>VK1 (1-236)<br>VL]::huKLC-CL (Pepti-<br>HC) | HSQGTFTSDVSSYLEEQAAKEFIEWLVKGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3519) |
| PL-47415 | iPS:<br>428055 | huGLP-1(A2G, E3D,<br>G16E, A24E,<br>R30G)::G::(AP)10::G::[hu<br>anti-<huGIPR> 21-<br>143_6H1 VH3<br>VH]::huIgG1zSEFL2-2 +<br>[Unknown anti-<br><huGIPR> 21-143_4B1<br>VK1 (1-236)<br>VL]::huKLC-CL (Pepti-<br>HC) | HGDGTFTSDVSSYLEEQAAKEFIEWLVKGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3520) |
| PL-47416 | iPS:<br>428056 | huGLP-1(A2S, E3D,<br>G16E, A24E,<br>R30G)::G::(AP)10::G::[hu<br>anti-<huGIPR> 21-<br>143_6H1 VH3<br>VH]::huIgG1zSEFL2-2 +<br>[Unknown anti- | HSDGTFTSDVSSYLEEQAAKEFIEWLVKGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP |

TABLE 8-continued

| anti-GIPR antibodies and GLP-1/anti-GIPR antibody fusion polypeptides | | | |
|---|---|---|---|
| | | <huGIPR> 21-143_4B1 VK1 (1-236) VL]::huKLC-CL (Pepti-HC) | PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3521) |
| PL-47417 | iPS: 428057 | huGLP-1(A2G, G16E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIAWLKNGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3522) |
| PL-47418 | iPS: 428058 | huGLP-1(A2S, G16E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIAWLKNGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3523) |
| PL-47419 | iPS: 428059 | huGLP-1(A2S, E3Q, G16E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIAWLKNGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3524) |
| PL-47420 | iPS: 428060 | huGLP-1(A2G, E3D, G16E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIAWLKNGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3525) |
| PL-47421 | iPS: 428061 | huGLP-1(A2S, E3D, G16E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSDGTFTSDVSSYLEEQAAKEFIAWLKNGGGGAPAPAPAPAPA<br>PAPAPAPAPGQVQLVESGGGVVQPGRSLRLSCAASGFTFSYFG<br>MHWVRQAPGKGLEWVAVIWYDGSNKYYADSVKGRFTISRDN<br>SKNTLYLQMNSLRAEDTAVYYCARDGTIFGVLLGDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3526) |

TABLE 8-continued

| anti-GIPR antibodies and GLP-1/anti-GIPR antibody fusion polypeptides | | | |
|---|---|---|---|
| PL-47422 | iPS: 428062 | huGLP-1(A2G, G16E, A24E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGEGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3527) |
| PL-47423 | iPS: 428063 | huGLP-1(A2S, G16E, A24E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3528) |
| PL-48490 | iPS: 428063 | huGLP-1(A2S, G16E, A24E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSEGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3529) |
| PL-47424 | iPS: 428064 | huGLP-1(A2S, E3Q, G16E, A24E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HSQGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3530) |
| PL-47425 | iPS: 428065 | huGLP-1(A2G, E3D, G16E, A24E, V27K, K28N, R30G)::G::(AP)10::G::[hu anti-<huGIPR> 21-143_6H1 VH3 VH]::huIgG1zSEFL2-2 + [Unknown anti-<huGIPR> 21-143_4B1 VK1 (1-236) VL]::huKLC-CL (Pepti-HC) | HGDGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3531) |
| PL-47426 | iPS: 428066 | huGLP-1(A2S, E3D, G16E, A24E, V27K, K28N, R30G)::G::(AP)10::G::[hu anti-<huGIPR> 21-143_6H1 VH3 VH]::huIgG1zSEFL2-2 + | HSDGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFP |

TABLE 8-continued anti-GIPR antibodies and GLP-1/anti-GIPR antibody fusion polypeptides

| | | | |
|---|---|---|---|
| | | [Unknown anti-<br><huGIPR> 21-143_4B1<br>VK1 (1-236)<br>VL]::huKLC-CL (Pepti-<br>HC) | PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3532) |
| PL-50123<br>PL-50581<br>PL-51747<br>PL-51763 | iPS:<br>472652 | huGLP1(Ana)::1KmodT<br>482V, M493L)::[hu anti-<br><huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEEQAAKEFIEWLKNGGGGSGSATGGSGSV<br>ASSGSGSATHLQVQLVESGGGVVQPGRSLRLSCAASGFTFSNY<br>GMHWVRQAPGEGLEWVAAIWFDASDKYYADAVKGRFTISRD<br>NSKNTLYLQMNSLRAEDTAVYYCARDQAIFGVVPDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3533) |
| PL-50155 | iPS:<br>472653 | huGLP1(Ana)::(AP)10::[hu<br>anti-<huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEEQAAKEFIEWLKNGGGGAPAPAPAPAPA<br>PAPAPAPAPGQVQLVESGGGVVQPGRSLRLSCAASGFTFSNYG<br>MHWVRQAPGEGLEWVAAIWFDASDKYYADAVKGRFTISRDN<br>SKNTLYLQMNSLRAEDTAVYYCARDQAIFGVVPDYWGQGTLV<br>TVSSASTKGPSVFPLAPSSKSTSGGTAALGCLVKDYFPEPVTVS<br>WNSGALTSGVHTFPAVLQSSGLYSLSSVVTVPSSSLGTQTYICN<br>VNHKPSNTKVDKKVEPKSCDKTHTCPPCPAPELLGGPSVFLFPP<br>KPKDTLMISRTPEVTCVVVDVSHEDPEVKFNWYVDGVEVHNA<br>KTKPCEEQYGSTYRCVSVLTVLHQDWLNGKEYKCKVSNKALP<br>APIEKTISKAKGQPREPQVYTLPPSREEMTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK<br>(SEQ ID NO: 3534) |
| PL-50124<br>PL-50582<br>PL-51748<br>PL-51764 | iPS:<br>472654 | huGLP1(Ana)::(G4A)3::[hu<br>anti-<huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEEQAAKEFIEWLKNGGGGGGGAGGGGAG<br>GGGAGGGGQVQLVESGGGVVQPGRSLRLSCAASGFTFSNYGM<br>HWVRQAPGEGLEWVAAIWFDASDKYYADAVKGRFTISRDNSK<br>NTLYLQMNSLRAEDTAVYYCARDQAIFGVVPDYWGQGTLVT<br>VSSASTKGPSVFPLAPSSKSTSGGTAALGCLVKDYFPEPVTVSW<br>NSGALTSGVHTFPAVLQSSGLYSLSSVVTVPSSSLGTQTYICNV<br>NHKPSNTKVDKKVEPKSCDKTHTCPPCPAPELLGGPSVFLFPPK<br>PKDTLMISRTPEVTCVVVDVSHEDPEVKFNWYVDGVEVHNAK<br>TKPCEEQYGSTYRCVSVLTVLHQDWLNGKEYKCKVSNKALPA<br>PIEKTISKAKGQPREPQVYTLPPSREEMTKNQVSLTCLVKGFYP<br>SDIAVEWESNGQPENNYKTTPPVLDSDGSFFLYSKLTVDKSRW<br>QQGNVFSCSVMHEALHNHYTQKSLSLSPGK<br>(SEQ ID NO: 3535) |
| PL-50156 | iPS:<br>472655 | huGLP1(Hyb)::1KmodT<br>482V, M493L)::[hu anti-<br><huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEGEAVRLFIEWLKNGGPSSGAPPPSGSGSA<br>TGGSGSVASSGSGSATHLQVQLVESGGGVVQPGRSLRLSCAAS<br>GFTFSNYGMHWVRQAPGEGLEWVAAIWFDASDKYYADAVKG<br>RFTISRDNSKNTLYLQMNSLRAEDTAVYYCARDQAIFGVVPDY<br>WGQGTLVTVSSASTKGPSVFPLAPSSKSTSGGTAALGCLVKDY<br>FPEPVTVSWNSGALTSGVHTFPAVLQSSGLYSLSSVVTVPSSSL<br>GTQTYICNVNHKPSNTKVDKKVEPKSCDKTHTCPPCPAPELLG<br>GPSVFLFPPKPKDTLMISRTPEVTCVVVDVSHEDPEVKFNWYV<br>DGVEVHNAKTKPCEEQYGSTYRCVSVLTVLHQDWLNGKEYK<br>CKVSNKALPAPIEKTISKAKGQPREPQVYTLPPSREEMTKNQVS<br>LTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 3536) |
| PL-50157 | iPS:<br>472656 | huGLP1(Hyb)::(AP)10::[hu<br>anti-<huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEGEAVRLFIEWLKNGGPSSGAPPPSGAPAP<br>APAPAPAPAPAPAPAPGQVQLVESGGGVVQPGRSLRLSCAASG<br>FTFSNYGMHWVRQAPGEGLEWVAAIWFDASDKYYADAVKGR<br>FTISRDNSKNTLYLQMNSLRAEDTAVYYCARDQAIFGVVPDY<br>WGQGTLVTVSSASTKGPSVFPLAPSSKSTSGGTAALGCLVKDY<br>FPEPVTVSWNSGALTSGVHTFPAVLQSSGLYSLSSVVTVPSSSL<br>GTQTYICNVNHKPSNTKVDKKVEPKSCDKTHTCPPCPAPELLG<br>GPSVFLFPPKPKDTLMISRTPEVTCVVVDVSHEDPEVKFNWYV<br>DGVEVHNAKTKPCEEQYGSTYRCVSVLTVLHQDWLNGKEYK<br>CKVSNKALPAPIEKTISKAKGQPREPQVYTLPPSREEMTKNQVS<br>LTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 3537) |

TABLE 8-continued

| anti-GIPR antibodies and GLP-1/anti-GIPR antibody fusion polypeptides | | | |
|---|---|---|---|
| PL-50159 | iPS:<br>472657 | huGLP1(Hyb)::(G4A)3::[hu<br>anti-<huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEGEAVRLFIEWLKNGGPSSGAPPPSGGGGA<br>GGGGAGGGGAGGGGQVQLVESGGGVVQPGRSLRLSCAASGFT<br>FSNYGMHWVRQAPGEGLEWVAAIWFDASDKYYADAVKGRFT<br>ISRDNSKNTLYLQMNSLRAEDTAVYYCARDQAIFGVVPDYWG<br>QGTLVTVSSASTKGPSVFPLAPSSKSTSGGTAALGCLVKDYFPE<br>PVTVSWNSGALTSGVHTFPAVLQSSGLYSLSSVVTVPSSSLGTQ<br>TYICNVNHKPSNTKVDKKVEPKSCDKTHTCPPCPAPELLGGPSV<br>FLFPPKPKDTLMISRTPEVTCVVVDVSHEDPEVKFNWYVDGVE<br>VHNAKTKPCEEQYGSTYRCVSVLTVLHQDWLNGKEYKCKVS<br>NKALPAPIEKTISKAKGQPREPQVYTLPPSREEMTKNQVSLTCL<br>VKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 3538) |
| PL-50125<br>PL-50583<br>PL-51749<br>PL-51765 | iPS:<br>472658 | huGLP1(Ana)::1Klinker<br>mod::[hu anti-<br><huGIPR> 21-<br>143_2G10_LC1 VK3<br>(1-236) VL]::huKLC-CL<br>[hu anti-<huGIPR><br>21-143_2G10_LC1.003<br>VH3 (1-<br>472)(S73(85)A, G65(77)<br>A)<br>VH]::huIgG1zSEFL2-2<br>(mAb-fusion) | HGEGTFTSDVSSYLEEQAAKEFIEWLKN<br>GGGGSGSATGGSGSVASSGSGSATHLEI<br>VMTQSPATLSVSPGERATLSCRASQSVSS<br>NLAWYQQKPGQAPRLLIYGAATRATGIP<br>ARVSGSGSGTEFTLTISSLQSEDFAVYYC<br>QQYNNWPLTFGGGTKVEIKRTVAAPSVF<br>IFPPSDEQLKSGTASVVCLLNNFYPREAK<br>VQWKVDNALQSGNSQESVTEQDSKDST<br>YSLSSTLTLSKADYEKHKVYACEVTHQG<br>LSSPVTKSFNRGEC<br>(SEQ ID NO: 3539) |
| PL-50160 | iPS:<br>472659 | huGLP1(Ana)::(AP)10::[hu<br>anti-<huGIPR> 21-<br>143_2G10_LC1 VK3<br>(1-236) VL]::huKLC-CL<br>[hu anti-<huGIPR><br>21-143_2G10_LC1.003<br>VH3 (1-<br>472)(S73(85)A, G65(77)<br>A)<br>VH]::huIgG1zSEFL2-2<br>(mAb-fusion) | HGEGTFTSDVSSYLEEQAAKEFIEWLKN<br>GGGGAPAPAPAPAPAPAPAPAPAPGEIV<br>MTQSPATLSVSPGERATLSCRASQSVSSN<br>LAWYQQKPGQAPRLLIYGAATRATGIPA<br>RVSGSGSGTEFTLTISSLQSEDFAVYYCQ<br>QYNNWPLTFGGGTKVEIKRTVAAPSVFI<br>FPPSDEQLKSGTASVVCLLNNFYPREAK<br>VQWKVDNALQSGNSQESVTEQDSKDST<br>YSLSSTLTLSKADYEKHKVYACEVTHQG<br>LSSPVTKSFNRGEC<br>(SEQ ID NO: 3540) |
| PL-50126<br>PL-50584<br>PL-51750<br>PL-51766<br>PL-54099 | iPS:<br>472660 | huGLP1(Ana)::(G4A)2:<br>G4::[hu anti-<huGIPR><br>21-143_2G10_LC1 VK3<br>(1-236) VL]::huKLC-CL<br>[hu anti-<huGIPR><br>21-143_2G10_LC1.003<br>VH3 (1-<br>472)(S73(85)A, G65(77)<br>A)<br>VH]::huIgG1zSEFL2-2<br>(mAb-fusion) | HGEGTFTSDVSSYLEEQAAKEFIEWLKN<br>GGGGGGGAGGGGAGGGGAGGGGGEIVM<br>TQSPATLSVSPGERATLSCRASQSVSSNL<br>AWYQQKPGQAPRLLIYGAATRATGIPAR<br>VSGSGSGTEFTLTISSLQSEDFAVYYCQQ<br>YNNWPLTFGGGTKVEIKRTVAAPSVFIFP<br>PSDEQLKSGTASVVCLLNNFYPREAKVQ<br>WKVDNALQSGNSQESVTEQDSKDSTYS<br>LSSTLTLSKADYEKHKVYACEVTHQGLS<br>SPVTKSFNRGEC<br>(SEQ ID NO: 3541) |
| PL-50161 | iPS:<br>472661 | huGLP1(Hyb)::1Klinker<br>mod::[hu anti-<br><huGIPR> 21-<br>143_2G10_LC1 VK3<br>(1-236) VL]::huKLC-CL<br>[hu anti-<huGIPR><br>21-143_2G10_LC1.003<br>VH3 (1-<br>472)(S73(85)A, G65(77)<br>A)<br>VH]::huIgG1zSEFL2-2<br>(mAb-fusion) | HGEGTFTSDVSSYLEGEAVRLFIEWLKN<br>GGPSSGAPPPSGSGSATGGSGSVASSGSG<br>SATHLEIVMTQSPATLSVSPGERATLSCR<br>ASQSVSSNLAWYQQKPGQAPRLLIYGAA<br>TRATGIPARVSGSGSGTEFTLTISSLQSED<br>FAVYYCQQYNNWPLTFGGGTKVEIKRT<br>VAAPSVFIFPPSDEQLKSGTASVVCLLNN<br>FYPREAKVQWKVDNALQSGNSQESVTE<br>QDSKDSTYSLSSTLTLSKADYEKHKVYA<br>CEVTHQGLSSPVTKSFNRGEC<br>(SEQ ID NO: 3542) |
| PL-50163 | iPS:<br>472662 | huGLP1(Hyb)::(AP)10::[hu<br>anti-<huGIPR> 21-<br>143_2G10_LC1 VK3<br>(1-236) VL]::huKLC-CL<br>[hu anti-<huGIPR><br>21-143_2G10_LC1.003<br>VH3 (1-<br>472)(S73(85)A, G65(77)<br>A)<br>VH]::huIgG1zSEFL2-2<br>(mAb-fusion) | HGEGTFTSDVSSYLEGEAVRLFIEWLKN<br>GGPSSGAPPPSGAPAPAPAPAPAPAPAPA<br>PAPGEIVMTQSPATLSVSPGERATLSCRA<br>SQSVSSNLAWYQQKPGQAPRLLIYGAAT<br>RATGIPARVSGSGSGTEFTLTISSLQSEDF<br>AVYYCQQYNNWPLTFGGGTKVEIKRTV<br>AAPSVFIFPPSDEQLKSGTASVVCLLNNF<br>YPREAKVQWKVDNALQSGNSQESVTEQ<br>DSKDSTYSLSSTLTLSKADYEKHKVYAC<br>EVTHQGLSSPVTKSFNRGEC<br>(SEQ ID NO: 3543) |

TABLE 8-continued

| anti-GIPR antibodies and GLP-1/anti-GIPR antibody fusion polypeptides | | | |
|---|---|---|---|
| PL-50165 | iPS: 472663 | huGLP1(Hyb)::(G4A)2: G4::[hu anti-<huGIPR> 21-143_2G10_LC1 VK3 (1-236) VL]::huKLC-CL [hu anti-<huGIPR> 21-143_2G10_LC1.003 VH3 (1-472)(S73(85)A, G65(77)A) VH]::huIgG1zSEFL2-2 (mAb-fusion) | HGEGTFTSDVSSYLEGEAVRLFIEWLKN GGPSSGAPPPSGGGGAGGGGAGGGGA GGGGEIVMTQSPATLSVSPGERATLSCR ASQSVSSNLAWYQQKPGQAPRLLIYGA ATRATGIPARVSGSGSGTEFTLTISSLQS EDFAVYYCQQYNNWPLTFGGGTKVEIK RTVAAPSVFIFPPSDEQLKSGTASVVCLL NNFYPREAKVQWKVDNALQSGNSQES VTEQDSKDSTYSLSSTLTLSKADYEKHK VYACEVTHQGLSSPVTKSFNRGEC (SEQ ID NO: 3544) |
| PL-50511 | iPS: 476644 | huGLP1(Ana)::1KmodT 482V, M493L)::[hu anti-<huGIPR> 21-143_2C2.005.013 VH1 (1-480)(R95(107)S, W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | HGEGTFTSDVSSYLEEQAAKEFIEWLKNGGGGSGSATGGSGSV ASSGSGSATHLQMQVVQSGAEVKKPGASVKVSCKASGYTFTG YYMHWVRQAPGQGLEWMGWINPNSGGTNYAQKFQGRVTMT RDTSISTAYMELSSLRSDDTAVYYCARGGDYVFGTYRPHYYYG MDVWGQGTTVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKKVEPKSCDKTHTCPPCPAPEL LGGPSVFLFPPKPKDTLMISRTPEVTCVVVDVSHEDPEVKFNW YVDGVEVHNAKTKPCEEQYGSTYRCVSVLTVLHQDWLNGKE YKCKVSNKALPAPIEKTISKAKGQPREPQVYTLPPSREEMTKNQ VSLTCLVKGFYPSDIAVEWESNGQPENNYKTTPPVLDSDGSFFL YSKLTVDKSRWQQGNVFSCSVMHEALHNHYTQKSLSLSPGK (SEQ ID NO: 3545) |
| PL-50512 | iPS: 476645 | huGLP1(Ana)::1KmodT 482V, M493L)::[hu anti-<huGIPR> 21-143_2C2.005.012 VL1 (1-235)(G136(117)A, D111(113)S, T40(52)Y) VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | HGEGTFTSDVSSYLEEQAAKEFIEWLKN GGGGSGSATGGSGSVASSGSGSATHLQS VLTQPPSASGTPGQRVTISCSGSSSNIGSN YVNWYQHLPGTAPKLLIYTNNQRPSGVP DRFSGSKSGTSASLAISGLQSEDEADYFC ATFDSSLNAPVFGGGTKLTVLGQPKAAP SVTLFPPSSEELQANKATLVCLISDFYPG AVTVAWKADSSPVKAGVETTTPSKQSN NKYAASSYLSLTPEQWKSHRSYSCQVTH EGSTVEKTVAPTECS (SEQ ID NO: 3546) |
| PL-50513 | iPS: 476646 | huGLP1(Ana)::(AP)10::[hu anti-<huGIPR> 21-143_2C2.005.013 VH1 (1-480)(R95(107)S, W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | HGEGTFTSDVSSYLEEQAAKEFIEWLKNGGGGAPAPAPAPAPA PAPAPAPAPGQMQVVQSGAEVKKPGASVKVSCKASGYTFTGY YMHWVRQAPGQGLEWMGWINPNSGGTNYAQKFQGRVTMTR DTSISTAYMELSSLRSDDTAVYYCARGGDYVFGTYRPHYYYG MDVWGQGTTVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKKVEPKSCDKTHTCPPCPAPEL LGGPSVFLFPPKPKDTLMISRTPEVTCVVVDVSHEDPEVKFNW YVDGVEVHNAKTKPCEEQYGSTYRCVSVLTVLHQDWLNGKE YKCKVSNKALPAPIEKTISKAKGQPREPQVYTLPPSREEMTKNQ VSLTCLVKGFYPSDIAVEWESNGQPENNYKTTPPVLDSDGSFFL YSKLTVDKSRWQQGNVFSCSVMHEALHNHYTQKSLSLSPGK (SEQ ID NO: 3547) |
| PL-50514 | iPS: 476647 | huGLP1(Ana)::(AP)10::[hu anti-<huGIPR> 21-143_2C2.005.012 VL1 (1-235)(G136(117)A, D111(113)S, T40(52)Y) VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | HGEGTFTSDVSSYLEEQAAKEFIEWLKNGGGG APAPAPAPAPAPAPAPAPAPGQSVLTQPPSASG TPGQRVTISCSGSSSNIGSNYVNWYQHLPGTAP KLLIYTNNQRPSGVPDRFSGSKSGTSASLAISGL QSEDEADYFCAENDSSLNAPVFGGGTKLTVLG QPKAAPSVTLFPPSSEELQANKATLVCLISDFYP GAVTVAWKADSSPVKAGVETTTPSKQSNNKY AASSYLSLTPEQWKSHRSYSCQVTHEGSTVEK TVAPTECS (SEQ ID NO: 3548) |
| PL-50515 | iPS: 476648 | huGLP1(Ana)::(G4A)3:: G4::[hu anti-<huGIPR> 21-143_2C2.005.013 VH1(1-480)(R95(107)S, | HGEGTFTSDVSSYLEEQAAKEFIEWLKNGGGGGGGAGGGGAG GGGAGGGGQMQVVQSGAEVKKPGASVKVSCKASGYTFTGYY MHWVRQAPGQGLEWMGWINPNSGGTNYAQKFQGRVTMTRD TSISTAYMELSSLRSDDTAVYYCARGGDYVFGTYRPHYYYGM DVWGQGTTVTVSSASTKGPSVFPLAPSSKSTSGGTAALGCLVK |

TABLE 8-continued

| anti-GIPR antibodies and GLP-1/anti-GIPR antibody fusion polypeptides | | | |
|---|---|---|---|
| | | W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | DYFPEPVTVSWNSGALTSGVHIFYAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3549) |
| PL-50516 | iPS: 476649 | huGLP1(Ana)::(G4A)3::G4::[hu anti-<huGIPR> 21-143_2C2.005.012 VL1 (1-235)(G136(117)A, D111(113)S, T40(52)Y) VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | HGEGTFTSDVSSYLEEQAAKEFIEWLKNGGGGGGGAGGGGAGGGGAGGGGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 3550) |
| PL-50517 | iPS: 476650 | huGLP1(Hyb)::1KmodT 482V, M493L)::[hu anti-<huGIPR> 21-143_2C2.005.013 VH1 (1-480)(R95(107)S, W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | HGEGTFTSDVSSYLEGEAVRLFIEWLKNGGPSSGAPPPSGSGSATGGSGSVASSGSGSATHLQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3551) |
| PL-50518 | iPS: 476651 | huGLP1(Hyb)::1KmodT 482V, M493L)::[hu anti-<huGIPR> 21-143_2C2.005.012 VL1 (1-235)(G136(117)A, D111(113)S, T40(52)Y) VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | HGEGTFTSDVSSYLEGEAVRLFIEWLKNGGPSSGAPPPSGSGSATGGSGSVASSGSGSATHLQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 3552) |
| PL-50519 | iPS: 476652 | huGLP1(Hyb)::(AP)10::[hu anti-<huGIPR> 21-143_2C2.005.013 VH1 (1-480)(R95(107)S, W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | HGEGTFTSDVSSYLEGEAVRLFIEWLKNGGPSSGAPPPSGAPAPAPAPAPAPAPAPAPAPGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3553) |
| PL-50520 | iPS: 476653 | huGLP1(Hyb)::(AP)10::[hu anti-<huGIPR> 21-143_2C2.005.012 VL1 (1-235)(G136(117)A, D111(113)S, T40(52)Y) | HGEGTFTSDVSSYLEGEAVRLFIEWLKNGGPSSGAPPPSGAPAPAPAPAPAPAPAPAPAPGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPV |

TABLE 8-continued

| anti-GIPR antibodies and GLP-1/anti-GIPR antibody fusion polypeptides | | | |
|---|---|---|---|
| | | VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | FGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 3554) |
| PL-50521 | iPS: 476654 | huGLP1(Hyb)::(G4A)3::G4::[hu anti-<huGIPR> 21-143_2C2.005.013 VH1(1-480)(R95(107)S, W114(126)F) VH]::huIgG1zSEFL2-2 + [hu anti-<huGIPR> 21-143_2C2.005.012 VL1 (1-235)(G136(117)A, D111(113)S, T40(52)Y) VL]::huLLC-C2 (mAb-fusion) | HGEGTFTSDVSSYLEGEAVRLFIEWLKNGGPSSGAPPPSGGGGAGGGGAGGGGAGGGGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3555) |
| PL-50522 | iPS: 476655 | huGLP1(Hyb)::(G4A)3::G4::[hu anti-<huGIPR> 21-143_2C2.005.012 VL1 (1-235)(G136(117)A, D111(113)S, T40(52)Y) VL]::huLLC-C2 + [hu anti-<huGIPR> 21-143_2C2.005.013 VH1 (1-480)(R95(107)S, W114(126)F) VH]::huIgG1zSEFL2-2 (mAb-fusion) | HGEGTFTSDVSSYLEGEAVRLFIEWLKNGGPSSGAPPPSGGGGAGGGGAGGGGAGGGGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS (SEQ ID NO: 3556) |
| PL-50523 PL-53170 | iPS: 476656 | huGLP1(Ana)::1KmodT 482V, M493L)::[hu anti-<huGIPR> 21-143_5G12.005 VH3 (1-473)(I41I, I58I) VH]::huIgG1zSEFL2-2 + [hu anti-<huGIPR> 21-143_5G12.006 VK1 (1-236)(C137(118)I) VL]::huKLC-CL (mAb-fusion) | HGEGTFTSDVSSYLEEQAAKEFIEWLKNGGGGSGSATGGSGSVASSGSGSATHLQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3557) |
| PL-50524 PL-53167 | iPS: 476657 | huGLP1(Ana)::1KmodT 482V, M493L)::[hu anti-<huGIPR> 21-143_5G12.006 VK1 (1-236)(C137(118)I) VL]::huLLC-C2 + [hu anti-<huGIPR> 21-143_5G12.005 VH3 (1-473)(I41I, I58I) VH]::huIgG1zSEFL2-2 (mAb-fusion) | HGEGTFTSDVSSYLEEQAAKEFIEWLKNGGGGSGSATGGSGSVASSGSGSATHLDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3558) |
| PL-50525 | iPS: 476658 | huGLP1(Ana)::(AP)10::[hu anti-<huGIPR> 21-143_5G12.005 VH3 (1-473)(I41I, I58I) VH]::huIgG1zSEFL2-2 + [hu anti-<huGIPR> 21-143_5G12.006 VK1 (1-236)(C137(118)I) VL]::huKLC-CL (mAb-fusion) | HGEGTFTSDVSSYLEEQAAKEFIEWLKNGGGGAPAPAPAPAPAPAPAPAPAPGQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3559) |

TABLE 8-continued anti-GIPR antibodies and GLP-1/anti-GIPR antibody fusion polypeptides

| | | | |
|---|---|---|---|
| PL-50526 | iPS: 476659 | huGLP1(Ana)::(AP)10::[hu anti-<huGIPR> 21-143_5G12.006 VK1 (1-236)(C137(118)I) VL]::huLLC-C2 + [hu anti-<huGIPR> 21-143_5G12.005 VH3 (1-473)(I41I, I58I) VH]::huIgG1zSEFL2-2 (mAb-fusion) | HGEGTFTSDVSSYLEEQAAKEFIEWLKNGGGG<br>APAPAPAPAPAPAPAPAPAPGDIQLTQSPSSLSA<br>SVGDRVTITCRASQTISRFLNWYQQKPGKAPEL<br>LIYVASSLQSGVPSRFSGSGSGTDFTLTISSLQPE<br>DFATYYCQQSYSTLISFGQGTKLEITRTVAAPS<br>VFIFPPSDEQLKSGTASVVCLLNNFYPREAKVQ<br>WKVDNALQSGNSQESVTEQDSKDSTYSLSSTL<br>TLSKADYEKHKVYACEVTHQGLSSPVTKSFNR<br>GEC (SEQ ID NO: 3560) |
| PL-50527 PL-53168 | iPS: 476660 | huGLP1(Ana)::(G4A)3::G4::[hu anti-<huGIPR> 21-143_5G12.005 VH3 (1-473)(I41I, 1581) VH]::huIgG1zSEFL2-2 + [hu anti-<huGIPR> 21-143_5G12.006 VK1 (1-236)(C137(118)I) VL]::huKLC-CL (mAb-fusion) | HGEGTFTSDVSSYLEEQAAKEFIEWLKNGGGGGGGAGGGGAGGGGAGGG<br>GQVQLVESGGGVVQPGRSLRLSCTASGFTFSSYGIHWVRQAPGKGLEWVA<br>VIWYDGSNKFHADSVKGRFTISRDNSKNTLYLQMNSLRAEDSAMYFCARG<br>KVAGMPEAFEIWGQGTKVTVSSASTKGPSVFPLAPSSKSTSGGTAALGCLV<br>KDYFPEPVTVSWNSGALTSGVHTFPAVLQSSGLYSLSSVVTVPSSSLGTQT<br>YICNVNHKPSNTKVDKKVEPKSCDKTHTCPPCPAPELLGGPSVFLFPPKPKD<br>TLMISRTPEVTCVVVDVSHEDPEVKFNWYVDGVEVHNAKTKPCEEQYGST<br>YRCVSVLTVLHQDWLNGKEYKCKVSNKALPAPIEKTISKAKGQPREPQVY<br>TLPPSREEMTKNQVSLTCLVKGFYPSDIAVEWESNGQPENNYKTTPPVLDS<br>DGSFFLYSKLTVDKSRWQQGNVFSCSVMHEALHNHYTQKSLSLSPGK<br>(SEQ ID NO: 3561) |
| PL-50528 PL-53169 | iPS: 476661 | huGLP1(Ana)::(G4A)3::G4::[hu anti-<huGIPR> 21-143_5G12.006 VK1 (1-236)(C137(118)I) VL]::huLLC-C2 + [hu anti-<huGIPR> 21-143_5G12.005 VH3 (1-473)(I41I, I58I) VH]::huIgG1zSEFL2-2 (mAb-fusion) | HGEGTFTSDVSSYLEEQAAKEFIEWLKN<br>GGGGGGGAGGGGAGGGGAGGGGDIQL<br>TQSPSSLSASVGDRVTITCRASQTISRFL<br>NWYQQKPGKAPELLIYVASSLQSGVPS<br>RFSGSGSGTDFTLTISSLQPEDFATYYCQ<br>QSYSTLISFGQGTKLEITRTVAAPSVFIFP<br>PSDEQLKSGTASVVCLLNNFYPREAKV<br>QWKVDNALQSGNSQESVTEQDSKDST<br>YSLSSTLTLSKADYEKHKVYACEVTHQ<br>GLSSPVTKSFNRGEC<br>(SEQ ID NO: 3562) |
| PL-50529 | iPS: 476662 | huGLP1(Hyb)::1KmodT 482V, M493L)::[hu anti-<huGIPR> 21-143_5G12.005 VH3 (1-473)(I41I, I58I) VH]::huIgG1zSEFL2-2 + [hu anti-<huGIPR> 21-143_5G12.006 VK1 (1-236)(C137(118)I) VL]::huKLC-CL (mAb-fusion) | HGEGTFTSDVSSYLEGEAVRLFIEWLKNGGPSSGAPPPSGSGSA<br>TGGSGSVASSGSGSATHLQVQLVESGGGVVQPGRSLRLSCTAS<br>GFTFSSYGIHWVRQAPGKGLEWVAVIWYDGSNKFHADSVKGR<br>FTISRDNSKNTLYLQMNSLRAEDSAMYFCARGKVAGMPEAFEI<br>WGQGTKVTVSSASTKGPSVFPLAPSSKSTSGGTAALGCLVKDY<br>FPEPVTVSWNSGALTSGVHTFPAVLQSSGLYSLSSVVTVPSSSL<br>GTQTYICNVNHKPSNTKVDKKVEPKSCDKTHTCPPCPAPELLG<br>GPSVFLFPPKPKDTLMISRTPEVTCVVVDVSHEDPEVKFNWYV<br>DGVEVHNAKTKPCEEQYGSTYRCVSVLTVLHQDWLNGKEYK<br>CKVSNKALPAPIEKTISKAKGQPREPQVYTLPPSREEMTKNQVS<br>LTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 3563) |
| PL-50530 | iPS: 476663 | huGLP1(Hyb)::1KmodT 482V, M493L)::[hu anti-<huGIPR> 21-143_5G12.006 VK1 (1-236)(C137(118)I) VL]::huLLC-C2 + [hu anti-<huGIPR> 21-143_5G12.005 VH3 (1-473)(I41I, I58I) VH]::huIgG1zSEFL2-2 (mAb-fusion) | HGEGTFTSDVSSYLEGEAVRLFIEWLKNG<br>GPSSGAPPPSGSGSATGGSGSVASSGSGSA<br>THLDIQLTQSPSSLSASVGDRVTITCRASQ<br>TISRFLNWYQQKPGKAPELLIYVASSLQS<br>GVPSRFSGSGSGTDFTLTISSLQPEDFATY<br>YCQQSYSTLISFGQGTKLEITRTVAAPSVFI<br>FPPSDEQLKSGTASVVCLLNNFYPREAKV<br>QWKVDNALQSGNSQESVTEQDSKDSTYS<br>LSSTLTLSKADYEKHKVYACEVTHQGLSS<br>PVTKSFNRGEC<br>(SEQ ID NO: 3564) |
| PL-50531 | iPS: 476664 | huGLP1(Hyb)::(AP)10::[hu anti-<huGIPR> 21-143_5G12.005 VH3 (1-473)(I41I, I58I) VH]::huIgG1zSEFL2-2 + [hu anti-<huGIPR> 21-143_5G12.006 VK1 (1-236)(C137(118)I) VL]::huKLC-CL (mAb-fusion) | HGEGTFTSDVSSYLEGEAVRLFIEWLKNGGPSSGAPPPSGAPAP<br>APAPAPAPAPAPAPAPGQVQLVESGGGVVQPGRSLRLSCTASG<br>FTFSSYGIHWVRQAPGKGLEWVAVIWYDGSNKFHADSVKGRF<br>TISRDNSKNTLYLQMNSLRAEDSAMYFCARGKVAGMPEAFEI<br>WGQGTKVTVSSASTKGPSVFPLAPSSKSTSGGTAALGCLVKDY<br>FPEPVTVSWNSGALTSGVHTFPAVLQSSGLYSLSSVVTVPSSSL<br>GTQTYICNVNHKPSNTKVDKKVEPKSCDKTHTCPPCPAPELLG<br>GPSVFLFPPKPKDTLMISRTPEVTCVVVDVSHEDPEVKFNWYV<br>DGVEVHNAKTKPCEEQYGSTYRCVSVLTVLHQDWLNGKEYK<br>CKVSNKALPAPIEKTISKAKGQPREPQVYTLPPSREEMTKNQVS<br>LTCLVKGFYPSDIAVEWESNGQPENNYKTTPPVLDSDGSFFLYS<br>KLTVDKSRWQQGNVFSCSVMHEALHNHYTQKSLSLSPGK<br>(SEQ ID NO: 3565) |

TABLE 8-continued

| anti-GIPR antibodies and GLP-1/anti-GIPR antibody fusion polypeptides | | | |
|---|---|---|---|
| PL-50532 | iPS:<br>476665 | huGLP1(Hyb)::(AP)10::[hu<br>anti-<huGIPR> 21-<br>143_5G12.006 VK1 (1-<br>236)(C137(118)I)<br>VL]::huLLC-C2 + [hu<br>anti-<huGIPR> 21-<br>143_5G12.005 VH3 (1-<br>473)(I41I, I58I)<br>VH]::huIgG1zSEFL2-2<br>(mAb-fusion) | HGEGTFTSDVSSYLEGEAVRLFIEWLKN<br>GGPSSGAPPPSGAPAPAPAPAPAPAPAP<br>APAPGDIQLTQSPSSLSASVGDRVTITCR<br>ASQTISRFLNWYQQKPGKAPELLIYVAS<br>SLQSGVPSRFSGSGSGTDFTLTISSLQPE<br>DFATYYCQQSYSTLISFGQGTKLEITRT<br>VAAPSVFIFPPSDEQLKSGTASVVCLLN<br>NFYPREAKVQWKVDNALQSGNSQESV<br>TEQDSKDSTYSLSSTLTLSKADYEKHKV<br>YACEVTHQGLSSPVTKSFNRGEC<br>(SEQ ID NO: 3566) |
| PL-50533 | iPS:<br>476666 | huGLP1(Hyb)::(G4A)3::<br>G4::[hu anti-<huGIPR><br>21-143_5G12.005 VH3<br>(1-473)(I41I, 1581)<br>VH]::huIgG1zSEFL2-2 +<br>[hu anti-<huGIPR><br>21-143_5G12.006 VK1<br>(1-236)(C137(118)I)<br>VL]::huKLC-CL (mAb-<br>fusion) | HGEGTFTSDVSSYLEGEAVRLFIEWLKNGGPSSGAPPPSGGGGA<br>GGGGAGGGGAGGGGQVQLVESGGGVVQPGRSLRLSCTASGFT<br>FSSYGIHWVRQAPGKGLEWVAVIWYDGSNKFHADSVKGRFTIS<br>RDNSKNTLYLQMNSLRAEDSAMYFCARGKVAGMPEAFEIWG<br>QGTKVTVSSASTKGPSVFPLAPSSKSTSGGTAALGCLVKDYFPE<br>PVTVSWNSGALTSGVHITPAVLQSSGLYSLSSVVTVPSSSLGTQ<br>TYICNVNHKPSNTKVDKKVEPKSCDKTHTCPPCPAPELLGGPSV<br>FLFPPKPKDTLMISRTPEVTCVVVDVSHEDPEVKFNWYVDGVE<br>VHNAKTKPCEEQYGSTYRCVSVLTVLHQDWLNGKEYKCKVS<br>NKALPAPIEKTISKAKGQPREPQVYTLPPSREEMTKNQVSLTCL<br>VKGFYPSDIAVEWESNGQPENNYKTTPPVLDSDGSFFLYSKLTV<br>DKSRWQQGNVFSCSVMHEALHNHYTQKSLSLSPGK<br>(SEQ ID NO: 3567) |
| PL-50534 | iPS:<br>476667 | huGLP1(Hyb)::(G4A)3::<br>G4::[hu anti-<huGIPR><br>21-143_5G12.006 VK1<br>(1-236)(C137(118)I)<br>VL]::huLLC-C2 + [hu<br>anti-<huGIPR> 21-<br>143_5G12.005 VH3 (1-<br>473)(I41I, I58I)<br>VH]::huIgG1zSEFL2-2<br>(mAb-fusion) | HGEGTFTSDVSSYLEGEAVRLFIEWLK<br>NGGPSSGAPPPSGGGGAGGGGAGGGG<br>AGGGGDIQLTQSPSSLSASVGDRVTITC<br>RASQTISRFLNWYQQKPGKAPELLIYV<br>ASSLQSGVPSRFSGSGSGTDFTLTISSLQ<br>PEDFATYYCQQSYSTLISFGQGTKLEIT<br>RTVAAPSVFIFPPSDEQLKSGTASVVCL<br>LNNFYPREAKVQWKVDNALQSGNSQE<br>SVTEQDSKDSTYSLSSTLTLSKADYEK<br>HKVYACEVTHQGLSSPVTKSFNRGEC<br>(SEQ ID NO: 3568) |
| PL-51752<br>PL-51753<br>PL-51768 | iPS:<br>478187 | huGLP1(Ana1)::1Kmod<br>T482V, M493L)::[hu<br>anti-<huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR><br>21-143_2G10_LC1 VK3<br>(1-236) VL]::huKLC-CL<br>(mAb-fusion) | HGEGTFTSDVSSYLEEQAAKEFIEWLVKGGGGSGSATGGSGSV<br>ASSGSGSATHLQVQLVESGGGVVQPGRSLRLSCAASGFTFSNY<br>GMHWVRQAPGEGLEWVAAIWFDASDKYYADAVKGRFTISRD<br>NSKNTLYLQMNSLRAEDTAVYYCARDQAIFGVVPDYWGQGTL<br>VTVSSASTKGPSVFPLAPSSKSTSGGTAALGCLVKDYFPEPVTV<br>SWNSGALTSGVHTFPAVLQSSGLYSLSSVVTVPSSSLGTQTYIC<br>NVNHKPSNTKVDKKVEPKSCDKTHTCPPCPAPELLGGPSVFLFP<br>PKPKDTLMISRTPEVTCVVVDVSHEDPEVKFNWYVDGVEVHN<br>AKTKPCEEQYGSTYRCVSVLTVLHQDWLNGKEYKCKVSNKAL<br>PAPIEKTISKAKGQPREPQVYTLPPSREEMTKNQVSLTCLVKGF<br>YPSDIAVEWESNGQPENNYKTTPPVLDSDGSFFLYSKLTVDKSR<br>WQQGNVFSCSVMHEALHNHYTQKSLSLSPGK<br>(SEQ ID NO: 3569) |
| PL-51754<br>PL-51761 | iPS:<br>478188 | huGLP1(Ana1)::1Kmod<br>T482V, M493L)::[hu<br>anti-<huGIPR> 21-<br>143_2G10_LC1 VK3<br>(1-236) VL]::huKLC-CL +<br>[hu anti-<huGIPR><br>21-143_2G10_LC1.003<br>VH3 (1-<br>472)(S73(85)A, G65(77)<br>A)<br>VH]::huIgG1zSEFL2-2 +<br>(mAb-fusion) | HGEGTFTSDVSSYLEEQAAKEFIEWLVK<br>GGGGSGSATGGSGSVASSGSGSATHLEI<br>VMTQSPATLSVSPGERATLSCRASQSVS<br>SNLAWYQQKPGQAPRLLIYGAATRATG<br>IPARVSGSGSGTEFTLTISSLQSEDFAVY<br>YCQQYNNWPLTFGGGTKVEIKRTVAAP<br>SVFIFPPSDEQLKSGTASVVCLLNNFYPR<br>EAKVQWKVDNALQSGNSQESVTEQDS<br>KDSTYSLSSTLTLSKADYEKHKVYACE<br>VTHQGLSSPVTKSFNRGEC<br>(SEQ ID NO: 3570) |
| PL-51751<br>PL-51756<br>PL-51767 | iPS:<br>478189 | huGLP1(Ana1)::(G4A)3<br>G4::[hu anti-<br><huGIPR> 21-<br>143_2G10_LC1.003<br>VH3 (1-<br>472)(S73(85)A, G65(77)<br>A)<br>VH]::huIgG1zSEFL2-2 +<br>[hu anti-<huGIPR> | HGEGTFTSDVSSYLEEQAAKEFIEWLVKGGGGGGGAGGGGAG<br>GGGAGGGGQVQLVESGGGVVQPGRSLRLSCAASGFTFSNYGM<br>HWVRQAPGEGLEWVAAIWFDASDKYYADAVKGRFTISRDNSK<br>NTLYLQMNSLRAEDTAVYYCARDQA1FGVVPDYWGQGTLVT<br>VSSASTKGPSVFPLAPSSKSTSGGTAALGCLVKDYFPEPVTVSW<br>NSGALTSGVHTFPAVLQSSGLYSLSSVVTVPSSSLGTQTYICNV<br>NHKPSNTKVDKKVEPKSCDKTHTCPPCPAPELLGGPSVFLFPPK<br>PKDTLMISRTPEVTCVVVDVSHEDPEVKFNWYVDGVEVHNAK<br>TKPCEEQYGSTYRCVSVLTVLHQDWLNGKEYKCKVSNKALPA |

TABLE 8-continued

| anti-GIPR antibodies and GLP-1/anti-GIPR antibody fusion polypeptides | | |
|---|---|---|
| | 21-143_2G10_LC1 VK3 (1-236) VL]::huKLC-CL (mAb-fusion) | PIEKTISKAKGQPREPQVYTLPPSREEMTKNQVSLTCLVKGFYP SDIAVEWESNGQPENNYKTTPPVLDSDGSFFLYSKLTVDKSRW QQGNVFSCSVMHEALHNHYTQKSLSLSPGK (SEQ ID NO: 3571) |
| PL-51757 iPS: PL-51762 478190 | huGLP1(Ana1)::(G4A)3::G4::[hu anti-<huGIPR> 21-143_2G10_LC1 VK3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSDVSSYLEEQAAKEFIEWLVKGGGGGGGA GGGGAGGGGAGGGGEIVMTQSPATLSVSPGERATLS CRASQSVSSNLAWYQQKPGQAPRLLIYGAATRATGI PARVSGSGSGTEFTLTISSLQSEDFAVYYCQQYNNWP LTFGGGTKVEIKRTVAAPSVFIFPPSDEQLKSGTASVV CLLNNFYPREAKVQWKVDNALQSGNSQESVTEQDS KDSTYSLSSTLTLSKADYEKHKVYACEVTHQGLSSP VTKSFNRGEC (SEQ ID NO: 3572) |
| PL-50353 iPS: PL-50366 484334 | huGLP1(Inc)::1KmodT482V, M493L)::[hu anti-<huGIPR> 21-143_2G10_LC1.003 VH3 (1-472)(S73(85)A, G65(77)A) VH]::huIgG1zSEFL2-2 + [hu anti-<huGIPR> 21-143_2G10_LC1 VK3 (1-236) VL]::huKLC-CL (mAb-fusion) | HGEGTFTSDYSSYLEEQAAKEFIEWLKNGGGGSGSATGGSGSV ASSGSGSATHLQVQLVESGGGVVQPGRSLRLSCAASGFTFSNY GMHWVRQAPGEGLEWVAAIWFDASDKYYADAVKGRFTISRD NSKNTLYLQMNSLRAEDTAVYYCARDQAIFGVVPDYWGQGTL VTVSSASTKGPSVFPLAPSSKSTSGGTAALGCLVKDYFPEPVTV SWNSGALTSGVHTFPAVLQSSGLYSLSSVVTVPSSSLGTQTYIC NVNHKPSNTKVDKKVEPKSCDKTHTCPPCPAPELLGGPSVFLFP PKPKDTLMISRTPEVTCVVVDVSHEDPEVKFNWYVDGVEVHN AKTKPCEEQYGSTYRCVSVLTVLHQDWLNGKEYKCKVSNKAL PAPIEKTISKAKGQPREPQVYTLPPSREEMTKNQVSLTCLVKGF YPSDIAVEWESNGQPENNYKTTPPVLDSDGSFFLYSKLTVDKSR WQQGNVFSCSVMHEALHNHYTQKSLSLSPGK (SEQ ID NO: 3573) |
| PL-50354 iPS: PL-50367 484335 | huGLP1(Inc)::1Klinker mod::[hu anti-<huGIPR> 21-143_2G10_LC1.003 VH3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSDYSSYLEEQAAKEFIEWLKNGGGGSG SATGGSGSVASSGSGSATHLEIVMTQSPATLSVSP GERATLSCRASQSVSSNLAWYQQKPGQAPRLLIY GAATRATGIPARVSGSGSGTEFTLTISSLQSEDFAV YYCQQYNNWPLTFGGGTKVEIKRTVAAPSVFIFPP SDEQLKSGTASVVCLLNNFYPREAKVQWKVDNA LQSGNSQESVTEQDSKDSTYSLSSTLTLSKADYEK HKVYACEVTHQGLSSPVTKSFNRGEC (SEQ ID NO: 3574) |
| PL-50355 iPS: PL-50368 484351 | huGLP1(Inc)::(AP)10::[hu anti-<huGIPR> 21-143_2G10_LC1.003 VH3 (1-472)(S73(85)A, G65(77)A) VH]::huIgG1zSEFL2-2 + [hu anti-<huGIPR> 21-143_2G10_LC1 VK3 (1-236) VL]::huKLC-CL (mAb-fusion) | HGEGTFTSDYSSYLEEQAAKEFIEWLKNGGGGAPAPAPAPAPAPAPAPAPA PGQVQLVESGGGVVQPGRSLRLSCAASGFTFSNYGMHWVRQAPGEGLEW VAAIWFDASDKYYADAVKGRFTISRDNSKNTLYLQMNSLRAEDTAVYYC ARDQAIFGVVPDYWGQGTLVTVSSASTKGPSVFPLAPSSKSTSGGTAALGC LVKDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPCEEQY GSTYRCVSVLTVLHQDWLNGKEYKCKVSNKALPAPIEKTISKAKGQPREP QVYTLPPSREEMTKNQVSLTCLVKGFYPSDIAVEWESNGQPENNYKTTPPV LDSDGSFFLYSKLTVDKSRWQQGNVFSCSVMHEALHNHYTQKSLSLSPGK (SEQ ID NO: 3575) |
| PL-50356 iPS: PL-50369 484352 | huGLP1(Inc)::(AP)10::[hu anti-<huGIPR> 21-143_2G10_LC1.003 VH3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSDYSSYLEEQAAKEFIE WLKNGGGGAPAPAPAPAPAPAP APAPAPGEIVMTQSPATLSVSPGE RATLSCRASQSVSSNLAWYQQKP GQAPRLLIYGAATRATGIPARVSG SGSGTEFTLTISSLQSEDFAVYYC QQYNNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3576) |
| PL-50357 iPS: PL-50370 484353 | huGLP1(Inc)::(G4A)3::G4::[hu anti-<huGIPR> 21-143_2G10_LC1.003 VH3 (1-472)(S73(85)A, G65(77)A) VH]::huIgG1zSEFL2-2 + | HGEGTFTSDYSSYLEEQAAKEFIEWLKNGGGGGGGAGGGGAGGGGAGGG GQVQLVESGGGVVQPGRSLRLSCAASGFTFSNYGMHWVRQAPGEGLEWV AAIWFDASDKYYADAVKGRFTISRDNSKNTLYLQMNSLRAEDTAVYYCA RDQAIFGVVPDYWGQGTLVTVSSASTKGPSVFPLAPSSKSTSGGTAALGCL VKDYFPEPVTVSWNSGALTSGVHTFPAVLQSSGLYSLSSVVTVPSSSLGTQ TYICNVNHKPSNTKVDKKVEPKSCDKTHTCPPCPAPELLGGPSVFLFPPKPK DTLMISRTPEVTCVVVDVSHEDPEVKFNWYVDGVEVHNAKTKPCEEQYGS |

TABLE 8-continued

| anti-GIPR antibodies and GLP-1/anti-GIPR antibody fusion polypeptides | | |
|---|---|---|
| | [hu anti-<huGIPR> 21-143_2G10_LC1 VK3 (1-236) VL]::huKLC-CL (mAb-fusion) | TYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3577) |
| PL-50358 iPS: PL-50371 484354 | huGLP1(Inc)::(G4A)3::G4::[hu anti-<huGIPR> 21-143_2G10_LC1.003 VH3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSDYSSYLEEQAAKEFIEWLKNGGGGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3578) |
| PL-50359 iPS: PL-50372 484387 | huGLP1(Low)::1KmodT 482V, M493L)::[hu anti-<huGIPR> 21-143_2G10_LC1.003 VH3 (1-472)(S73(85)A, G65(77)A) VH]::huIgG1zSEFL2-2 + [hu anti-<huGIPR> 21-143_2G10_LC1 VK3 (1-236) VL]::huKLC-CL (mAb-fusion) | HGEGTFTSEVSSYLEGQAAKEFIEWLKNGGGGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3579) |
| PL-50360 iPS: PL-50373 484389 | huGLP1(Low)::1KmodT 482V, M493L)::[hu anti-<huGIPR> 21-143_2G10_LC1.003 VH3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSEVSSYLEGQAAKEFIEWLKNGGGGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3580) |
| PL-50361 iPS: PL-50374 484391 | huGLP1(Low)::(AP)10::[hu anti-<huGIPR> 21-143_2G10_LC1.003 VH3 (1-472)(S73(85)A, G65(77)A) VH]::huIgG1zSEFL2-2 + [hu anti-<huGIPR> 21-143_2G10_LC1 VK3 (1-236) VL]::huKLC-CL (mAb-fusion) | HGEGTFTSEVSSYLEGQAAKEFIEWLKNGGGGAPAPAPAPAPAPAPAPAPAPAPGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3581) |
| PL-50362 iPS: 484393 | huGLP1(Low)::(AP)10::[hu anti-<huGIPR> 21-143_2G10_LC1.003 VH3 (1-236) VL]::huKLC-CL + [hu anti-<huGIPR> 21-143_2G10_LC1.003 VH3 (1-472)(S73(85)A, G65(77)A) VH]::huIgG1zSEFL2-2 (mAb-fusion) | HGEGTFTSEVSSYLEGQAAKEFIEWLKNGGGGAPAPAPAPAPAPAPAPAPAPGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3582) |
| PL-50363 iPS: 484395 | huGLP1(Low)::(G4A)3::G4::[hu anti-<huGIPR> 21-143_2G10_LC1.003 VH3 (1-472)(S73(85)A, G65(77)A) VH]::huIgG1zSEFL2-2 + [hu anti-<huGIPR> | HGEGTFTSEVSSYLEGQAAKEFIEWLKNGGGGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQV |

TABLE 8-continued anti-GIPR antibodies and GLP-1/anti-GIPR antibody fusion polypeptides

| | | | |
|---|---|---|---|
| | | 21-143_2G10_LC1 VK3 (1-236) VL]::huKLC-CL (mAb-fusion) | YTLPPSREEMTKNQVSLTCLVKGFYPSDIAVEWESNGQPENNYKTTPPVLD SDGSFFLYSKLTVDKSRWQQGNVFSCSVMHEALHNHYTQKSLSLSPGK (SEQ ID NO: 3583) |
| PL-50364 | iPS: 484397 | huGLP1(Low)::(G4A)3: :G4::[hu anti-<huGIPR> 21-143_2G10_LC1.003 VH3 (1-236) VLCDR]::huKLC-CL + [hu anti-<huGIPR> 21- 143_2G10_LC1.003 VH3 (1- 472)(S73(85)A, G65(77) A) VH]::huIgG1zSEFL2-2 (mAb-fusion) | HGEGTFTSEVSSYLEGQAAKEFIE WLKNGGGGGGGAGGGGAGGGG AGGGGEIVMTQSPATLSVSPGER ATLSCRASQSVSSNLAWYQQKPG QAPRLLIYGAATRATGIPARVSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3584) |
| PL-54037 | iPS: 547118 | VK1:huGLP1(G29E):(G 4::[hu anti-<huGIPR> G29E_361174 VK3 (1- 286) VL]::huKLC-CL + [hu anti-<huGIPR> SST200067 VH3 (1- 472) VH]::huIgG1zSEFL2-2 (mAb) | HGEGTFTSDVSSYLEEQAAKEFIE WLKNEGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3585) |
| PL-54100 | iPS: 547125 | VK1:huGLP1(G29E):(G 4::[hu anti-<huGIPR> G29E_471479 VK3 (1- 286) VL]::huKLC-CL + [hu anti-<huGIPR> G29E_471439_ VH3 (1- 472) VH]::huIgG1zSEFL2-2 (mAb) | HGEGTFTSDVSSYLEEQAAKEFIE WLKNEGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3586) |
| PL-54101 | iPS: 547129 | VK1:huGLP1(G29E):(G 4::[hu anti-<huGIPR> G29E_529362 VK3 (1- 286) VL]::huKLC-CL + [hu anti-<huGIPR> SST200067VH3 (1- 472) VH]::huIgG1zSEFL2-2 (mAb) | HGEGTFTSDVSSYLEEQAAKEFIE WLKNEGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3587) |
| PL-54039 | iPS: 547133 | VK1:huGLP1(G29E):(G 4::[hu anti-<huGIPR> G29E_529367 VK3 (1- 286) VL]::huKLC-CL + [hu anti-<huGIPR> G29E_471439_ VH3 (1- 472) VH]::huIgG1zSEFL2-2 (mAb) | HGEGTFTSDVSSYLEEQAAKEFIE WLKNEGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3588) |
| PL-54040 | iPS: 547137 | VK1:huGLP1(G29E):(G 4::[hu anti-<huGIPR> G29E_529368 VK3 (1- 286) VL]::huKLC-CL + [hu anti-<huGIPR> G29E_471439_ VH3 (1- 472) VH]::huIgG1zSEFL2-2 (mAb) | HGEGTFTSDVSSYLEEQAAKEFIE WLKNEGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN |

TABLE 8-continued

| anti-GIPR antibodies and GLP-1/anti-GIPR antibody fusion polypeptides | | | |
|---|---|---|---|
| | | | SQESVTEQDSKDSTYSLSSTLTLSKADYEKHKVYACEVTHQGLSSPVTKSFNRGEC (SEQ ID NO: 3589) |
| PL-54032 | iPS: 547141 | VK1:huGLP1(G29E, A2 S)::[hu anti-<huGIPR> G29E(A2S)_361174 VK3 (1-286) VL]::huKLC-CL + [hu anti-<huGIPR> SST200067VH3 (1-472) VH]::huIgG1zSEFL2-2 (mAb) | HSEGTFTSDVSSYLEEQAAKEFIEWLKNEGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3590) |
| PL-54034 | iPS: 547148 | VK1:huGLP1(G29E, A2 S)::[hu anti-<huGIPR> G29E(A2S)_471479 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNEGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3591) |
| PL-54102 | iPS: 547152 | VK1:huGLP1(G29E, A2 S)::[hu anti-<huGIPR> G29E(A2S)_529362 VK3 (1-286) VL]::huKLC-CL + [hu anti-<huGIPR> SST200067VH3 (1-472) VH]::huIgG1zSEFL2-2 (mAb) | HSEGTFTSDVSSYLEEQAAKEFIEWLKNEGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3592) |
| PL-54035 | iPS: 547156 | VK1:huGLP1(G29E, A2 S)::[hu anti-<huGIPR> G29E(A2S)_529367 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNEGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3593) |
| PL-54036 | iPS: 547160 | VK1:huGLP1(G29E, A2 S)::[hu anti-<huGIPR> G29E(A2S)_529368 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNEGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3594) |
| PL-54047 | iPS: 547164 | VK1:huGLP1(G29P):(G 4::[hu anti-<huGIPR> G29P_361174 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIEWLKNPGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGN |

TABLE 8-continued anti-GIPR antibodies and GLP-1/anti-GIPR antibody fusion polypeptides

| | | | |
|---|---|---|---|
| | | | SQESVTEQDSKDSTYSLSSTLTLS KADYEKHKVYACEVTHQGLSSP VTKSFNRGEC (SEQ ID NO: 3595) |
| PL-54049 | iPS: 547171 | VK1:huGLP1(G29P):(G 4::[hu anti-<huGIPR> G29P_471479 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNPGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3596) |
| PL-54050 | iPS: 547175 | VK1:huGLP1(G29P):(G 4::[hu anti-<huGIPR> G29P_529362 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNPGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3597) |
| PL-54051 | iPS: 547179 | VK1:huGLP1(G29P):(G 4::[hu anti-<huGIPR> G29P_529367 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNPGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3598) |
| PL-54052 | iPS: 547183 | VK1:huGLP1(G29P):(G 4::[hu anti-<huGIPR> G29P_529368 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNPGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3599) |
| PL-54041 | iPS: 547187 | VK1:huGLP1(G29P, A2 S)::[hu anti-<huGIPR> G29P(A2S)_361174 VK3 (1-286) VL]::huKLC-CL + [hu anti-<huGIPR> SST200067VH3 (1-472) VH]::huIgG1zSEFL2-2 (mAb) | HSEGTFTSDVSSYLEEQAAKEFIE WLKNPGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3600) |
| PL-54043 | iPS: 547194 | VK1:huGLP1(G29P, A2 S)::[hu anti-<huGIPR> G29P(A2S)_471479 VK3 (1-286) VL]::huKLC-CL + [hu anti-<huGIPR> | HSEGTFTSDVSSYLEEQAAKEFIE WLKNPGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC |

TABLE 8-continued

| anti-GIPR antibodies and GLP-1/anti-GIPR antibody fusion polypeptides | | | |
|---|---|---|---|
| | | G29E_471439_ VH3 (1-472) VH]::huIgG1zSEFL2-2 (mAb) | QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3601) |
| PL-54044 | iPS: 547198 | VK1:huGLP1(G29P, A2 S)::[hu anti-<huGIPR> G29P(A2S)_529362 VK3 (1-286) VL]::huKLC-CL + [hu anti-<huGIPR> SST200067VH3 (1-472) VH]::huIgG1zSEFL2-2 (mAb) | MDMRVPAQLLGLLLLWLRGARC HSEGTFTSDVSSYLEEQAAKEFIE WLKNPGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3602) |
| PL-54045 | iPS: 547202 | VK1:huGLP1(G29P, A2 S)::[hu anti-<huGIPR> G29P(A2S)_529367 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKNPGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3603) |
| PL-54046 | iPS: 547206 | VK1:huGLP1(G29P, A2 S)::[hu anti-<huGIPR> G29P(A2S)_529368 VK3 (1-286) VL]::huKLC-CL + [hu anti-<huGIPR> G29E_471439_ VH3 (1-472) VH]::huIgG1zSEFL2-2 (mAb) | MDMRVPAQLLGLLLLWLRGARC HSEGTFTSDVSSYLEEQAAKEFIE WLKNPGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3604) |
| PL-54059 | iPS: 547210 | VK1:huGLP1(G29Q):(G 4::[hu anti-<huGIPR> G29Q_361174 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNQGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3605) |
| PL-54061 | iPS: 547217 | VK1:huGLP1(G29Q):(G 4::[hu anti-<huGIPR> G29Q_471479 VK3 (1-286) VL]::huKLC-CL + [hu anti-<huGIPR> G29E_471439_ VH3 (1-472) VH]::huIgG1zSEFL2-2 (mAb) | MDMRVPAQLLGLLLLWLRGARC HGEGTFTSDVSSYLEEQAAKEFIE WLKNQGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3606) |
| PL-54062 | iPS: 547221 | VK1:huGLP1(G29Q):(G 4::[hu anti-<huGIPR> G29Q_529362 VK3 (1- | HGEGTFTSDVSSYLEEQAAKEFIE WLKNQGGGGGGAGGGGAGGGG AGGGGEIVLTQSPATLSLSPGERA |

TABLE 8-continued

| anti-GIPR antibodies and GLP-1/anti-GIPR antibody fusion polypeptides | | | |
|---|---|---|---|
| | | 286) VL]::huKLC-CL +<br>[hu anti-<huGIPR><br>SST200067 VH3 (1-<br>472)<br>VH]::huIgG1zSEFL2-2<br>(mAb) | TLSCRASQSVSSNLAWYQQKPGQ<br>APRLLIYGAATRATGIPDRFSGSG<br>SGTEFTLTISRLEPEDFAVYYCQQ<br>YNNWPLTFGGGTKVEIKRTVAAP<br>SVFIFPPSDEQLKSGTASVVCLLN<br>NFYPREAKVQWKVDNALQSGNS<br>QESVTEQDSKDSTYSLSSTLTLSK<br>ADYEKHKVYACEVTHQGLSSPVT<br>KSFNRGEC (SEQ ID NO: 3607) |
| PL-54063 | iPS:<br>547225 | VK1:huGLP1(G29Q):(G<br>4::[hu anti-<huGIPR><br>G29Q_529367 VK3 (1-<br>286) VL]::huKLC-CL +<br>[hu anti-<huGIPR><br>G29E_471439_ VH3 (1-<br>472)<br>VH]::huIgG1zSEFL2-2<br>(mAb) | HGEGTFTSDVSSYLEEQAAKEFIE<br>WLKNQGGGGGGAGGGGAGGGG<br>AGGGGEIVLTQSPATLSLSPGERA<br>TLSCRASQSVLSHLAWYQQKPGQ<br>APRLLIYEAATRATGIPDRFSGSG<br>SGTEFTLTISRLEPEDFAVYYCQQ<br>YQNWPLTFGGGTKVEIKRTVAAP<br>SVFIFPPSDEQLKSGTASVVCLLN<br>NFYPREAKVQWKVDNALQSGNS<br>QESVTEQDSKDSTYSLSSTLTLSK<br>ADYEKHKVYACEVTHQGLSSPVT<br>KSFNRGEC (SEQ ID NO: 3608) |
| PL-54064 | iPS:<br>547229 | VK1:huGLP1(G29Q):(G<br>4::[hu anti-<huGIPR><br>G29Q_529368 VK3 (1-<br>286) VL]::huKLC-CL +<br>[hu anti-<huGIPR><br>G29E_471439_ VH3 (1-<br>472)<br>VH]::huIgG1zSEFL2-2<br>(mAb) | HGEGTFTSDVSSYLEEQAAKEFIE<br>WLKNQGGGGGGAGGGGAGGGG<br>AGGGGEIVLTQSPATLSLSPGERA<br>TLSCRASQSVDLHLAWYQQKPG<br>QAPRLLIYEAATRATGIPDRFSGS<br>GSGTEFTLTISRLEPEDFAVYYCQ<br>QYQNWPLTFGGGTKVEIKRTVAA<br>PSVFIFPPSDEQLKSGTASVVCLL<br>NNFYPREAKVQWKVDNALQSGN<br>SQESVTEQDSKDSTYSLSSTLTLS<br>KADYEKHKVYACEVTHQGLSSP<br>VTKSFNRGEC (SEQ ID NO: 3609) |
| PL-54053 | iPS:<br>547233 | VK1:huGLP1(G29Q, A2<br>S)::[hu anti-<huGIPR><br>G29Q(A2S)_361174<br>VK3 (1-286)<br>VL]::huKLC-CL + [hu<br>anti-<huGIPR><br>SST200067VH3 (1-<br>472)<br>VH]::huIgG1zSEFL2-2<br>(mAb) | HSEGTFTSDVSSYLEEQAAKEFIE<br>WLKNQGGGGGGAGGGGAGGGG<br>AGGGGEIVMTQSPATLSVSPGER<br>ATLSCRASQSVSSNLAWYQQKPG<br>QAPRLLIYGAATRATGIPARFSGS<br>GSGTEFTLTISSLQSEDFAVYYCQ<br>QYNNWPLTFGGGTKVEIKRTVAA<br>PSVFIFPPSDEQLKSGTASVVCLL<br>NNFYPREAKVQWKVDNALQSGN<br>SQESVTEQDSKDSTYSLSSTLTLS<br>KADYEKHKVYACEVTHQGLSSP<br>VTKSFNRGEC (SEQ ID NO: 3610) |
| PL-54055 | iPS:<br>547240 | VK1:huGLP1(G29Q, A2<br>S)::[hu anti-<huGIPR><br>G29Q(A2S)_471479<br>VK3 (1-286)<br>VL]::huKLC-CL + [hu<br>anti-<huGIPR><br>G29E_471439_ VH3 (1-<br>472)<br>VH]::huIgG1zSEFL2-2<br>(mAb) | HSEGTFTSDVSSYLEEQAAKEFIE<br>WLKNQGGGGGGAGGGGAGGGG<br>AGGGGEIVMTQSPATLSVSPGER<br>ATLSCRASQSVDLHLAWYQQKP<br>GQAPRLLIYEAATRATGIPARFSG<br>SGSGTEFTLTISSLQSEDFAVYYC<br>QQYQNWPLTFGGGTKVEIKRTVA<br>APSVFIFPPSDEQLKSGTASVVCL<br>LNNFYPREAKVQWKVDNALQSG<br>NSQESVTEQDSKDSTYSLSSTLTL<br>SKADYEKHKVYACEVTHQGLSSP<br>VTKSFNRGEC (SEQ ID NO: 3611) |
| PL-54056 | iPS:<br>547244 | VK1:huGLP1(G29Q, A2<br>S)::[hu anti-<huGIPR><br>G29Q(A2S)_529362<br>VK3 (1-286)<br>VL]::huKLC-CL + [hu<br>anti-<huGIPR><br>SST200067 VH3 (1-<br>472)<br>VH]::huIgG1zSEFL2-2<br>(mAb) | HSEGTFTSDVSSYLEEQAAKEFIE<br>WLKNQGGGGGGAGGGGAGGGG<br>AGGGGEIVLTQSPATLSLSPGERA<br>TLSCRASQSVSSNLAWYQQKPGQ<br>APRLLIYGAATRATGIPDRFSGSG<br>SGTEFTLTISRLEPEDFAVYYCQQ<br>YNNWPLTFGGGTKVEIKRTVAAP<br>SVFIFPPSDEQLKSGTASVVCLLN<br>NFYPREAKVQWKVDNALQSGNS<br>QESVTEQDSKDSTYSLSSTLTLSK<br>ADYEKHKVYACEVTHQGLSSPVT<br>KSFNRGEC (SEQ ID NO: 3612) |
| PL-54057 | iPS:<br>547248 | VK1:huGLP1(G29Q, A2<br>S)::[hu anti-<huGIPR><br>G29Q(A2S)_529367 | HSEGTFTSDVSSYLEEQAAKEFIE<br>WLKNQGGGGGGAGGGGAGGGG<br>AGGGGEIVLTQSPATLSLSPGERA |

TABLE 8-continued

| anti-GIPR antibodies and GLP-1/anti-GIPR antibody fusion polypeptides | | | |
|---|---|---|---|
| | | VK3 (1-286) VL]::huKLC-CL + [hu anti-<huGIPR> G29E_471439_ VH3 (1-472) VH]::huIgG1zSEFL2-2 (mAb) | TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3613) |
| PL-54058 | iPS: 547252 | VK1:huGLP1(G29Q, A2S)::[hu anti-<huGIPR> G29Q(A2S)_529368 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKNQGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3614) |
| PL-54071 | iPS: 547256 | VK1:huGLP1(G29T):(G4::[hu anti-<huGIPR> G29T_361174 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNTGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3615) |
| PL-54073 | iPS: 547263 | VK1:huGLP1(G29T):(G4::[hu anti-<huGIPR> G29T_471479 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNTGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3616) |
| PL-54074 | iPS: 547267 | VK1:huGLP1(G29T):(G4::[hu anti-<huGIPR> G29T_529362 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNTGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3617) |
| PL-54075 | iPS: 547271 | VK1:huGLP1(G29T):(G4::[hu anti-<huGIPR> G29T_529367 VK3 (1-286) VL]::huKLC-CL + [hu anti-<huGIPR> G29E_471439_ VH3 (1-472) VH]::huIgG1zSEFL2-2 (mAb) | MDMRVPAQLLGLLLLWLRGARC HGEGTFTSDVSSYLEEQAAKEFIE WLKNTGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3618) |
| PL-54076 | iPS: 547275 | VK1:huGLP1(G29T):(G4::[hu anti-<huGIPR> | MDMRVPAQLLGLLLLWLRGARC HGEGTFTSDVSSYLEEQAAKEFIE |

TABLE 8-continued

| anti-GIPR antibodies and GLP-1/anti-GIPR antibody fusion polypeptides | | | |
|---|---|---|---|
| | | G29T_529368 VK3 (1-286) VL]::huKLC-CL + [hu anti-<huGIPR> G29E_471439_ VH3 (1-472) VH]::huIgG1zSEFL2-2 (mAb) | WLKNTGGGGGGAGGGGAGGGG<br>AGGGGEIVLTQSPATLSLSPGERA<br>TLSCRASQSVDLHLAWYQQKPG<br>QAPRLLIYEAATRATGIPDRFSGS<br>GSGTEFTLTISRLEPEDFAVYYCQ<br>QYQNWPLTFGGGTKVEIKRTVAA<br>PSVFIFPPSDEQLKSGTASVVCLL<br>NNFYPREAKVQWKVDNALQSGN<br>SQESVTEQDSKDSTYSLSSTLTLS<br>KADYEKHKVYACEVTHQGLSSP<br>VTKSFNRGEC (SEQ ID NO: 3619) |
| PL-54065 | iPS: 547279 | VK1:huGLP1(G29T, A2 S)::[hu anti-<huGIPR> G29T(A2S)_361174 VK3 (1-286) VL]::huKLC-CL + [hu anti-<huGIPR> SST200067 VH3 (1-472) VH]::huIgG1zSEFL2-2 (mAb) | MDMRVPAQLLGLLLLWLRGARC<br>HSEGTFTSDVSSYLEEQAAKEFIE<br>WLKNTGGGGGGAGGGGAGGGG<br>AGGGGEIVMTQSPATLSVSPGER<br>ATLSCRASQSVSSNLAWYQQKPG<br>QAPRLLIYGAATRATGIPARFSGS<br>GSGTEFTLTISSLQSEDFAVYYCQ<br>QYNNWPLTFGGGTKVEIKRTVAA<br>PSVFIFPPSDEQLKSGTASVVCLL<br>NNFYPREAKVQWKVDNALQSGN<br>SQESVTEQDSKDSTYSLSSTLTLS<br>KADYEKHKVYACEVTHQGLSSP<br>VTKSFNRGEC (SEQ ID NO: 3620) |
| PL-54067 | iPS: 547286 | VK1:huGLP1(G29T, A2 S)::[hu anti-<huGIPR> G29T(A2S)_471479 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE<br>WLKNTGGGGGGAGGGGAGGGG<br>AGGGGEIVMTQSPATLSVSPGER<br>ATLSCRASQSVDLHLAWYQQKP<br>GQAPRLLIYEAATRATGIPARFSG<br>SGSGTEFTLTISSLQSEDFAVYYC<br>QQYQNWPLTFGGGTKVEIKRTVA<br>APSVFIFPPSDEQLKSGTASVVCL<br>LNNFYPREAKVQWKVDNALQSG<br>NSQESVTEQDSKDSTYSLSSTLTL<br>SKADYEKHKVYACEVTHQGLSSP<br>VTKSFNRGEC (SEQ ID NO: 3621) |
| PL-54068 | iPS: 547290 | VK1:huGLP1(G29T, A2 S)::[hu anti-<huGIPR> G29T(A2S)_529362 VK3 (1-286) VL]::huKLC-CL + [hu anti-<huGIPR> SST200067 VH3 (1-472) VH]::huIgG1zSEFL2-2 (mAb) | HSEGTFTSDVSSYLEEQAAKEFIE<br>WLKNTGGGGGGAGGGGAGGGG<br>AGGGGEIVLTQSPATLSLSPGERA<br>TLSCRASQSVSSNLAWYQQKPGQ<br>APRLLIYGAATRATGIPDRFSGSG<br>SGTEFTLTISRLEPEDFAVYYCQQ<br>YNNWPLTFGGGTKVEIKRTVAAP<br>SVFIFPPSDEQLKSGTASVVCLLN<br>NFYPREAKVQWKVDNALQSGNS<br>QESVTEQDSKDSTYSLSSTLTLSK<br>ADYEKHKVYACEVTHQGLSSPVT<br>KSFNRGEC (SEQ ID NO: 3622) |
| PL-54069 | iPS: 547294 | VK1:huGLP1(G29T, A2 S)::[hu anti-<huGIPR> G29T(A2S)_529367 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE<br>WLKNTGGGGGGAGGGGAGGGG<br>AGGGGEIVLTQSPATLSLSPGERA<br>TLSCRASQSVLSHLAWYQQKPGQ<br>APRLLIYEAATRATGIPDRFSGSG<br>SGTEFTLTISRLEPEDFAVYYCQQ<br>YQNWPLTFGGGTKVEIKRTVAAP<br>SVFIFPPSDEQLKSGTASVVCLLN<br>NFYPREAKVQWKVDNALQSGNS<br>QESVTEQDSKDSTYSLSSTLTLSK<br>ADYEKHKVYACEVTHQGLSSPVT<br>KSFNRGEC (SEQ ID NO: 3623) |
| PL-54070 | iPS: 547298 | VK1:huGLP1(G29T, A2 S)::[hu anti-<huGIPR> G29T(A2S)_529368 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE<br>WLKNTGGGGGGAGGGGAGGGG<br>AGGGGEIVLTQSPATLSLSPGERA<br>TLSCRASQSVDLHLAWYQQKPG<br>QAPRLLIYEAATRATGIPDRFSGS<br>GSGTEFTLTISRLEPEDFAVYYCQ<br>QYQNWPLTFGGGTKVEIKRTVAA<br>PSVFIFPPSDEQLKSGTASVVCLL<br>NNFYPREAKVQWKVDNALQSGN<br>SQESVTEQDSKDSTYSLSSTLTLS<br>KADYEKHKVYACEVTHQGLSSP<br>VTKSFNRGEC (SEQ ID NO: 3624) |

TABLE 8-continued

| anti-GIPR antibodies and GLP-1/anti-GIPR antibody fusion polypeptides | | | |
|---|---|---|---|
| PL-54083 | iPS: 547302 | VK1:huGLP1(G29V):(G 4::[hu anti-<huGIPR> G29V361174VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNVGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3625) |
| PL-54085 | iPS: 547309 | VK1:huGLP1(G29V):(G 4::[hu anti-<huGIPR> G29V_471479 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNVGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3626) |
| PL-54086 | iPS: 547313 | VK1:huGLP1(G29V):(G 4::[hu anti-<huGIPR> G29V_529362 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKNVGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3627) |
| PL-54087 | iPS: 547317 | VK1:huGLP1(G29V):(G 4::[hu anti-<huGIPR> G29V_529367 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNVGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3628) |
| PL-54088 | iPS: 547321 | VK1:huGLP1(G29V):(G 4::[hu anti-<huGIPR> G29V_529368 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKNVGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3629) |
| PL-54077 | iPS: 547325 | VK1:huGLP1(G29V, A2 S)::[hu anti-<huGIPR> G29V(A2S)_361174 VK3 (1-286) VL]::huKLC-CL + [hu anti-<huGIPR> SST200067 VH3 (1-472) VH]::huIgG1zSEFL2-2 (mAb) | HSEGTFTSDVSSYLEEQAAKEFIE WLKNVGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3630) |

TABLE 8-continued

| anti-GIPR antibodies and GLP-1/anti-GIPR antibody fusion polypeptides | | | |
|---|---|---|---|
| PL-54079 | iPS: 547332 | VK1:huGLP1(G29V, A2 S)::[hu anti-<huGIPR> G29V(A2S)_471479 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKNVGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3631) |
| PL-54080 | iPS: 547336 | VK1:huGLP1(G29V, A2 S)::[hu anti-<huGIPR> G29V(A2S)_529362 VK3 (1-286) VL]::huKLC-CL + [hu anti-<huGIPR> SST200067 VH3 (1-472) VH]::huIgG1zSEFL2-2 (mAb) | HSEGTFTSDVSSYLEEQAAKEFIE WLKNVGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3632) |
| PL-54081 | iPS: 547340 | VK1:huGLP1(G29V, A2 S)::[hu anti-<huGIPR> G29V(A2S)_529367 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKNVGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3633) |
| PL-54082 | iSP: 547344 | VK1:huGLP1(G29V, A2 S)::[hu anti-<huGIPR> G29V(A2S)_529368 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKNVGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3634) |
| PL-54094 | iSP: 547348 | VK1:huGLP1(K28Q):(G 4::[hu anti-<huGIPR> K28Q_361174 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKQGGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3635) |
| PL-54096 | iPS: 547355 | VK1:huGLP1(K28Q):(G 4::[hu anti-<huGIPR> K28Q_471479 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKQGGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3636) |

TABLE 8-continued

| anti-GIPR antibodies and GLP-1/anti-GIPR antibody fusion polypeptides | | | |
|---|---|---|---|
| PL-54097 | iPS: 547359 | VK1:huGLP1(K28Q):(G 4::[hu anti-<huGIPR> K28Q_529362 VK3 (1-286) VL]::huKLC-CL + [hu anti-<huGIPR> SST200067 VH3 (1-472) VH]::huIgG1zSEFL2-2 (mAb) | HGEGTFTSDVSSYLEEQAAKEFIE WLKQGGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3637) |
| PL-54098 | iPS: 547363 | VK1:huGLP1(K28Q):(G 4::[hu anti-<huGIPR> K28Q_529367 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKQGGGGGGGAGGGGAGGGG AGGGGEIVLTQSPATLSLSPGERA TLSCRASQSVLSHLAWYQQKPGQ APRLLIYEAATRATGIPDRFSGSG SGTEFTLTISRLEPEDFAVYYCQQ YQNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3638) |
| PL-54103 | iPS: 547367 | VK1:huGLP1(K28Q):(G 4::[hu anti-<huGIPR> K28Q_529368 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKQGGGGGGGAGGGGAGGGG AGGGGEIVLTQSPATLSLSPGERA TLSCRASQSVDLHLAWYQQKPG QAPRLLIYEAATRATGIPDRFSGS GSGTEFTLTISRLEPEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3639) |
| PL-54089 | iPS: 547371 | VK1:huGLP1(K28Q, A2 S)::[hu anti-<huGIPR> K28Q(A2S)_361174 VK3 (1-286) VL]::huKLC-CL + [hu anti-<huGIPR> SST200067 VH3 (1-472) VH]::huIgG1zSEFL2-2 (mAb) | HSEGTFTSDVSSYLEEQAAKEFIE WLKQGGGGGGGAGGGGAGGGG AGGGGEIVMTQSPATLSVSPGER ATLSCRASQSVSSNLAWYQQKPG QAPRLLIYGAATRATGIPARFSGS GSGTEFTLTISSLQSEDFAVYYCQ QYNNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3640) |
| PL-54091 | iPS: 547378 | VK1:huGLP1(K28Q, A2 S)::[hu anti-<huGIPR> K28Q(A2S)_471479 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKQGGGGGGGAGGGGAGGGG AGGGGEIVMTQSPATLSVSPGER ATLSCRASQSVDLHLAWYQQKP GQAPRLLIYEAATRATGIPARFSG SGSGTEFTLTISSLQSEDFAVYYC QQYQNWPLTFGGGTKVEIKRTVA APSVFIFPPSDEQLKSGTASVVCL LNNFYPREAKVQWKVDNALQSG NSQESVTEQDSKDSTYSLSSTLTL SKADYEKHKVYACEVTHQGLSSP VTKSFNRGEC (SEQ ID NO: 3641) |
| PL-54092 | iSP: 547382 | VK1:huGLP1(K28Q, A2 S)::[hu anti-<huGIPR> K28Q(A2S)_529362 VK3 (1-286) VL]::huKLC-CL + [hu anti-<huGIPR> SST200067 VH3 (1-472) VH]::huIgG1zSEFL2-2 (mAb) | HSEGTFTSDVSSYLEEQAAKEFIE WLKQGGGGGGGAGGGGAGGGG AGGGGEIVLTQSPATLSLSPGERA TLSCRASQSVSSNLAWYQQKPGQ APRLLIYGAATRATGIPDRFSGSG SGTEFTLTISRLEPEDFAVYYCQQ YNNWPLTFGGGTKVEIKRTVAAP SVFIFPPSDEQLKSGTASVVCLLN NFYPREAKVQWKVDNALQSGNS QESVTEQDSKDSTYSLSSTLTLSK ADYEKHKVYACEVTHQGLSSPVT KSFNRGEC (SEQ ID NO: 3642) |

TABLE 8-continued

| anti-GIPR antibodies and GLP-1/anti-GIPR antibody fusion polypeptides | | | |
|---|---|---|---|
| PL-54093 | iSP: 547386 | VK1:huGLP1(K28Q, A2 S)::[hu anti-<huGIPR> K28Q(A2S)_529367 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKQGGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3643) |
| PL-54104 | iPS: 547390 | VK1:huGLP1(K28Q, A2 S)::[hu anti-<huGIPR> K28Q(A2S)_529368 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKQGGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3644) |
| PL-54038 | iPS: 552363 | VK1:huGLP1(G29E):(G 4::[hu anti-<huGIPR> G29E_471439_ VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIEWLKNEGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3645) |
| PL-54033 | iPS: 552367 | VK1:huGLP1(G29E, A2 S)::[hu anti-<huGIPR> G29E(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNEGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3646) |
| PL-54048 | iPS: 552371 | VK1:huGLP1(G29P):(G 4::[hu anti-<huGIPR> G29P_471439_ VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIEWLKNPGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3647) |
| PL-54042 | iPS: 552375 | VK1:huGLP1(G29P, A2 S)::[hu anti-<huGIPR> G29P(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNPGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3648) |

TABLE 8-continued

| anti-GIPR antibodies and GLP-1/anti-GIPR antibody fusion polypeptides | | | |
|---|---|---|---|
| PL-54060 | iPS: 552379 | VK1:huGLP1(G29Q):(G4::[hu anti-<huGIPR> G29Q_471439 VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIEWLKNQGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3649) |
| PL-54054 | iPS: 552383 | VK1:huGLP1(G29Q, A2S)::[hu anti-<huGIPR> G29Q(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNQGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3650) |
| PL-54072 | iPS: 552387 | VK1:huGLP1(G29T):(G4::[hu anti-<huGIPR> G29T_471439_ VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIEWLKNTGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3651) |
| PL-54066 | iPS: 552391 | VK1:huGLP1(G29T, A2S)::[hu anti-<huGIPR> G29T(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNTGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3652) |
| PL-54084 | iPS: 552395 | VK1:huGLP1(G29V):(G4::[hu anti-<huGIPR> G29V_471439_ VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIEWLKNVGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3653) |
| PL-54078 | iPS: 552399 | VK1:huGLP1(G29V, A2S)::[hu anti-<huGIPR> G29V(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIEWLKNVGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC (SEQ ID NO: 3654) |

TABLE 8-continued anti-GIPR antibodies and GLP-1/anti-GIPR antibody fusion polypeptides

| | | | |
|---|---|---|---|
| PL-54095 | iPS: 552403 | VK1:huGLP1(K28Q):(G 4::[hu anti-<huGIPR> K28Q_471439_ VK3 (1-286) VL]::huKLC-CL + [hu anti-<huGIPR> G29E_471439_ VH3 (1-472) VH]::huIgG1zSEFL2-2 (mAb) | HGEGTFTSDVSSYLEEQAAKEFIE WLKQGGGGGGGAGGGGAGGGG AGGGGEIVMTQSPATLSVSPGER ATLSCRASQSVLSHLAWYQQKPG QAPRLLIYEAATRATGIPARFSGS GSGTEFTLTISSLQSEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3655) |
| PL-54090 | iPS: 552407 | VK1:huGLP1(K28Q, A2 S)::[hu anti-<huGIPR> K28Q(A2S)_471439 VK3 (1-286) VL]::huKLC-CL + [hu anti-<huGIPR> G29E_471439_ VH3 (1-472) VH]::huIgG1zSEFL2-2 (mAb) | HSEGTFTSDVSSYLEEQAAKEFIE WLKQGGGGGGGAGGGGAGGGG AGGGGEIVMTQSPATLSVSPGER ATLSCRASQSVLSHLAWYQQKPG QAPRLLIYEAATRATGIPARFSGS GSGTEFTLTISSLQSEDFAVYYCQ QYQNWPLTFGGGTKVEIKRTVAA PSVFIFPPSDEQLKSGTASVVCLL NNFYPREAKVQWKVDNALQSGN SQESVTEQDSKDSTYSLSSTLTLS KADYEKHKVYACEVTHQGLSSP VTKSFNRGEC (SEQ ID NO: 3656) |

| Lot(s) | Sequence 2 |
|---|---|
| PL-42410 | QVQLVESGGGVVQPGRSLRLSCAASGFTFSNFGMHWVRQAPGKGLEW VAVIWYDGSNENYADSVKGRFTISRDNSKNTLYLHMNSLRAADTAVY YCARDGTIFGVVLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3657) |
| PL-42411 | QVQLVESGGGVVQPGRSLRLSCAASGFTFSNFGMHWVRQAPGKGLEW VAVIWYDGSNENYADSVKGRFTISRDNSKNTLYLHMNSLRAADTAVY YCARDGTIFGVVLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPCVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3658) |
| PL-42412 | QVQLVESGGGVVQPGRSLRLSCAASGFTFSNFGMHWVRQAPGKGLEW VAVIWYDGSNENYADSVKGRFTISRDNSKNTLYLHMNSLRAADTAVY YCARDGTIFGVVLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMCKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3659) |
| PL-42409 PL-43909 | QVQLVESGGGVVQPGRSLRLSCTASGFTFSSYGIHWVRQAPGKGLEWV AVIWYDGSNKFHADSVKGRFTISRDNSKNTLYLQMNSLRAEDSAMYF CARGKVAGMPEAFEIWGQGTKVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3660) |
| PL-42476 | EVQLVESGGGVVQPGRSLRLSCTASGFTFSSYGIHWVRQAPGKGLEWV AVIWYDGSNKFHADSVKGRFTISRDNSKNTLYLQMNSLRAEDSAMYF CARGKVAGMPEAFEIWGQGTKVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV |

TABLE 8-continued

| anti-GIPR antibodies and GLP-1/anti-GIPR antibody fusion polypeptides | |
|---|---|
| | HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3661) |
| PL-42475<br>PL-43910<br>PL-49579 | QVQLVESGGGVVQPGRSLRLSCTASGFTFSSYGIHWVRQAPGKGLEWV AVIWYDGSNKFHADSVKGRFTISRDNSKNTLYLQMNSLRAEDSAMYF CARGKVAGMPEAFEIWGQGTKVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPCVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3662) |
| PL-42474<br>PL-43911 | QVQLVESGGGVVQPGRSLRLSCTASGFTFSSYGIHWVRQAPGKGLEWV AVIWYDGSNKFHADSVKGRFTISRDNSKNTLYLQMNSLRAEDSAMYF CARGKVAGMPEAFEIWGQGTKVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMCKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3663) |
| PL42477 | EVQLVESGGGVVQPGRSLRLSCAASGFTFSNFGMHWVRQAPGKGLEW VAVIWYDGSNENYADSVKGRFTISRDNSKNTLYLHMNSLRAADTAVY YCARDGTIFGVVLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3664) |
| PL-42487 | QVQLVESGGGVVQPGRSLRLSCAASGFTFSYFGMHWVRQAPGKGLEW VAVIWYDGSNKYYADSVKGRFTISRDNSKNTLYLQMNSLRAEDTAVY YCARDGTIFGVLLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3665) |
| PL-42834<br>PL-46306 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3666) |
| PL-42835<br>PL-42860 | QVQLVESGGGVVQPGRSLRLSCTASGFTFSSYGIHWVRQAPGKGL EWVAVIWYDGSNKFHADSVKGRFTISRDNSKNTLYLQMNSLRAE DSAMYFCARGKVAGMPEAFEIWGQGTKVTVSSASTKGPSVFPLA PSSKSTSGGTAALGCLVKDYFPEPVTVSWNSGALTSGVHTFPAVL QSSGLYSLSSVVTVPSSSLGTQTYICNVNHKPSNTKVDKKVEPKSC DKTHTCPPCPAPELLGGPSVFLFPPKPKDTLMISRTPEVTCVVVDV SHEDPEVKFNWYVDGVEVHNAKTKPCEEQYGSTYRCVSVLTVL HQDWLNGKEYKCKVSNKALPAPIEKTISKAKGQPREPQVYTLPPS REEMTKNQVSLTCLVKGFYPSDIAVEWESNGQPENNYKTTPPVL DSDGSFFLYSKLTVDKSRWQQGNVFSCSVMHEALHNHYTQKSLS LSPGK (SEQ ID NO: 3667) |

TABLE 8-continued

| anti-GIPR antibodies and GLP-1/anti-GIPR antibody fusion polypeptides | |
|---|---|
| PL-42836<br>PL-42861<br>PL-43385<br>PL-43386 | DIQLTQSPSSLSASVGDRVTIT<br>CRASQTISRFLNWYQQKPGK<br>APELLIYVASSLQSGVPSRFSG<br>SGSGTDFTLTISSLQPEDFATY<br>YCQQSYSTLISFGQGTKLEITR<br>TVAAPSVFIFPPSDEQLKSGTA<br>SVVCLLNNFYPREAKVQWKV<br>DNALQSGNSQESVTEQDSKD<br>STYSLSSTLTLSKADYEKHKV<br>YACEVTHQGLSSPVTKSFNRG<br>EC (SEQ ID NO: 3668) |
| PL-42837 | QVQLVESGGGVVQPGRSLRLSCAASGFTFSNFGMHWVRQAPGKG<br>LEWVAVIWYDGSNENYADSVKGRFTISRDNSKNTLYLHMNSLRA<br>ADTAVYYCARDGTIFGVVLGDYWGQGTLVTVSSASTKGPSVFPLA<br>PSSKSTSGGTAALGCLVKDYFPEPVTVSWNSGALTSGVHTFPAVLQ<br>SSGLYSLSSVVTVPSSSLGTQTYICNVNHKPSNTKVDKKVEPKSCD<br>KTHTCPPCPAPELLGGPSVFLFPPKPKDTLMISRTPEVTCVVVDVSH<br>EDPEVKFNWYVDGVEVHNAKTKPCEEQYGSTYRCVSVLTVLHQD<br>WLNGKEYKCKVSNKALPAPIEKTISKAKGQPREPQVYTLPPSREEM<br>TKNQVSLTCLVKGFYPSDIAVEWESNGQPENNYKTTPPVLDSDGSF<br>FLYSKLTVDKSRWQQGNVFSCSVMHEALHNHYTQKSLSLSPGK<br>(SEQ ID NO: 3669) |
| PL-43383<br>PL-43384 | DIQMTQSPSSLSASIGDRVTITC<br>RASQDLRNYLGWYHQKPGKA<br>PKRLIYGASSLQSGVPSRFSGSG<br>SGTEFTLTISSLQPEDFATYYCL<br>QHNNYPFTFGPGTKVDIKRTV<br>AAPSVFIFPPSDEQLKSGTASVV<br>CLLNNFYPREAKVQWKVDNA<br>LQSGNSQESVTEQDSKDSTYSL<br>SSTLTLSKADYEKHKVYACEV<br>THQGLSSPVTKSFNRGEC (SEQ ID NO: 3670) |
| PL-42471<br>PL-47504<br>PL-42815<br>PL-42816<br>PL-42817 | DIQMTQSPSSVSASVGDRVTIT<br>CRASQGISRRLAWYQQKPGKA<br>PKLLIYAASSLQSGVPSRFSGSG<br>SGTDFTLTISSLQPEDFATYYCQ<br>QANSFPFTFGPGTKVDIKRTVA<br>APSVFIFPPSDEQLKSGTASVVC<br>LLNNFYPREAKVQWKVDNAL<br>QSGNSQESVTEQDSKDSTYSLS<br>STLTLSKADYEKHKVYACEVT<br>HQGLSSPVTKSFNRGEC (SEQ ID NO: 3671) |
| PL-42838<br>PL-42839 | QVQLVESGGGVVQPGRSLRLSCAASGFTLSSYGMHWVRQAPGKGL<br>EWVAVIWYDGSNKYYADSVKGRFTISRDNSKNTLYLQMNSLRAED<br>TAVYYCARGGGSGSYRYYYYGLDVWGQGTTVTVSSASTKGPSVFP<br>LAPCSRSTSESTAALGCLVKDYFPEPVTVSWNSGALTSGVHTFPAVL<br>QSSGLYSLSSVVTVPSSNFGTQTYTCNVDHKPSNTKVDKTVERKCC<br>VECPPCPAPPVAGPSVFLFPPKPKDTLMISRTPEVTCVVVDVSHEDPE<br>VQFNWYVDGVEVHNAKTKPREEQFNSTFRVVSVLTVVHQDWLNG<br>KEYKCKVSNKGLPAPIEKTISKTKGQPREPQVYTLPPSREEMTKNQV<br>SLTCLVKGFYPSDIAVEWESNGQPENNYKTTPPMLDSDGSFFLYSKL<br>TVDKSRWQQGNVFSCSVMHEALHNHYTQKSLSLSPGK<br>(SEQ ID NO: 3672) |
| PL-42840<br>PL-42841 | QVQLVESGGGVVQPGRSLRLSCAASGFTLSSYGMHWVRQAPGKGL<br>EWVAVIWYDGSNKYYADSVKGRFTISRDNSKNTLYLQMNSLRAED<br>TAVYYCARGGGSGSYRYYYYGLDVWGQGTTVTVSSASTKGPSVFP<br>LAPCSRSTSESTAALGCLVKDYFPEPVTVSWNSGALTSGVHTFPAVL<br>QSSGLYSLSSVVTVPSSNFGTQTYTCNVDHKPSNTKVDKTVERKCC<br>VECPPCPAPPVAGPSVFLFPPKPKDTLMISRTPEVTCVVVDVSHEDPE<br>VQFNWYVDGVEVHNAKTKPREEQFNSTFRVVSVLTVVHQDWLNG<br>KEYKCKVSNKGLPAPIEKTISKTKGQPREPQVYTLPPSREEMTKNQV<br>SLTCLVKGFYPSDIAVEWESNGQPENNYKTTPPMLDSDGSFFLYSKL<br>TVDKSRWQQGNVFSCSVMHEALHNHYTQKSLSLSPGK<br>(SEQ ID NO: 3673) |
| PL-42842<br>PL-42843 | QVQLVESGGGVVQPGRSLRLSCAASGFTLSSYGMHWVRQAPGKGL<br>EWVAVIWYDGSNKYYADSVKGRFTISRDNSKNTLYLQMNSLRAED<br>TAVYYCARGGGSGSYRYYYYGLDVWGQGTTVTVSSASTKGPSVFP<br>LAPCSRSTSESTAALGCLVKDYFPEPVTVSWNSGALTSGVHTFPAVL<br>QSSGLYSLSSVVTVPSSNFGTQTYTCNVDHKPSNTKVDKTVERKCC<br>VECPPCPAPPVAGPSVFLFPPKPKDTLMISRTPEVTCVVVDVSHEDPE<br>VQFNWYVDGVEVHNAKTKPREEQFNSTFRVVSVLTVVHQDWLNG |

TABLE 8-continued

| anti-GIPR antibodies and GLP-1/anti-GIPR antibody fusion polypeptides | |
|---|---|
| | KEYKCKVSNKGLPAPIEKTISKTKGQPREPQVYTLPPSREEMTKNQV SLTCLVKGFYPSDIAVEWESNGQPENNYKTTPPMLDSDGSFFLYSKL TVDKSRWQQGNVFSCSVMHEALHNHYTQKSLSLSPGK (SEQ ID NO: 3674) |
| PL-42844<br>PL-43387<br>PL-43388<br>PL-43389<br>PL-42862 | QVQLVESGGGVVQPGRSLRLSCAASGFTLSSYGMHWVRQAPGKGL EWVAVIWYDGSNKYYADSVKGRFTISRDNSKNTLYLQMNSLRAED TAVYYCARGGGSGSYRYYYYGLDVWGQGTTVTVSSASTKGPSVFP LAPCSRSTSESTAALGCLVKDYFPEPVTVSWNSGALTSGVHTFPAVL QSSGLYSLSSVVTVPSSNFGTQTYTCNVDHKPSNTKVDKTVERKCC VECPPCPAPPVAGPSVFLFPPKPKDTLMISRTPEVTCVVVDVSHEDPE VQFNWYVDGVEVHNAKTKPREEQFNSTFRVVSVLTVVHQDWLNG KEYKCKVSNKGLPAPIEKTISKTKGQPREPQVYTLPPSREEMTKNQV SLTCLVKGFYPSDIAVEWESNGQPENNYKTTPPMLDSDGSFFLYSKL TVDKSRWQQGNVFSCSVMHEALHNHYTQKSLSLSPGK (SEQ ID NO: 3675) |
| PL-42465 | DIVMTQSPSSLAMSVGQKVTMS CKSSQSLLNSSNQKNYLAWYQQ KPGQSPKLLIYFASTRESGVPDRF IGSGSGTDFTLTISSVQAEDLADY FCQQHYYTPYTFGGGTKLEIKRT VAAPSVFIFPPSDEQLKSGTASVV CLLNNFYPREAKVQWKVDNALQ SGNSQESVTEQDSKDSTYSLSSTL TLSKADYEKHKVYACEVTHQGL SSPVTKSFNRGEC (SEQ ID NO: 3676) |
| PL-45575 | QVQLVESGGGVVQPGRSLRLSCAASGFTFSYFGMHWVRQAPGKGLEW VAVIWYDGSNKYYADSVKGRFTISRDNSKNTLYLQMNSLRAEDTAVY YCARDGTIFGVLLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3677) |
| PL-45573 | QVQLVESGGGVVQPGRSLRLSCAASGFTFSYFGMHWVRQAPGKGLEW VAVIWYDGSNKYYADSVKGRFTISRDNSKNTLYLQMNSLRAEDTAVY YCARDGTIFGVLLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMCKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3678) |
| PL-45574 | QVQLVESGGGVVQPGRSLRLSCAASGFTFSYFGMHWVRQAPGKGLEW VAVIWYDGSNKYYADSVKGRFTISRDNSKNTLYLQMNSLRAEDTAVY YCARDGTIFGVLLGDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPCVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3679) |
| PL-45588<br>PL-45589 | DIQMTQSPSSLSASEGDRVTIT CRASQGIRNDLGWYQQKPGK APKRLIYAASSLQSGVPLRFS GSGSGTEFTLTISSLQPEDFAT YYCLQYNSYPWTFGQGTKVE IKRTVAAPSVFIFPPSDEQLKS GTASVVCLLNNFYPREAKVQ WKVDNALQSGNSQESVTEQD SKDSTYSLSSTLTLSKADYEK HKVYACEVTHQGLSSPVTKSF NRGEC (SEQ ID NO: 3680) |
| PL-45590 | DIQMTQSPSSLSASEGDRVTIT CRASQGIRNDLGWYQQKPGK APKRLIYAASSLQSGVPLRFS GSGSGTEFTLTISSLQPEDFAT YYCLQYNSYPWTFGQGTKVE |

TABLE 8-continued

| anti-GIPR antibodies and GLP-1/anti-GIPR antibody fusion polypeptides | |
|---|---|
| | IKRTVAAPSVFIFPPSDEQLKS GTASVVCLLNNFYPREAKVQ WKVDNALQSGNSQESVTEQD SKDSTYSLSSTLTLSKADYEK HKVYACEVTHQGLSSPVTKSF NRGEC (SEQ ID NO: 3681) |
| PL-45584 PL-45585 | EIVLTQSPGTLSLSPGERATLS CRASQGISRSELAWYQQKPG QAPSLLIYGASSRATGIPDRFS GSGSGTDFTLTISRLEPEDFAV YYCQQFGSSPWTFGQGTKVEI KRTVAAPSVFIFPPSDEQLKSG TASVVCLLNNFYPREAKVQW KVDNALQSGNSQESVTEQDS KDSTYSLSSTLTLSKADYEKH KVYACEVTHQGLSSPVTKSFN RGEC (SEQ ID NO: 3682) |
| PL-45586 PL-45587 | EIVLTQSPGTLSLSPGERATLS CRASQGISRSELAWYQQKPG QAPSLLIYGASSRATGIPDRFS GSGSGTDFTLTISRLEPEDFAV YYCQQFGSSPWTFGQGTKVEI KRTVAAPSVFIFPPSDEQLKSG TASVVCLLNNFYPREAKVQW KVDNALQSGNSQESVTEQDS KDSTYSLSSTLTLSKADYEKH KVYACEVTHQGLSSPVTKSFN RGEC (SEQ ID NO: 3683) |
| PL-45556 PL-47367 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3684) |
| PL-45557 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3685) |
| PL-45557 PL-45558 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3686) |
| PL-45578 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3687) |

TABLE 8-continued

| anti-GIPR antibodies and GLP-1/anti-GIPR antibody fusion polypeptides | |
|---|---|
| PL-45579 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3688) |
| PL-45580 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3689) |
| PL-45576 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3690) |
| PL-45577 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3691) |
| PL-45581 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3692) |
| PL-45582 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3693) |
| PL-45583 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK |

TABLE 8-continued

| anti-GIPR antibodies and GLP-1/anti-GIPR antibody fusion polypeptides | |
|---|---|
| | RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3694) |
| PL-45559 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3695) |
| PL-45560 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3696) |
| PL-45561 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3697) |
| PL-45562 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3698) |
| PL-45563 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3699) |
| PL-46301 | EIVMTQSPATLSVSPGERATLS CRASQSVSSNLAWYQQKPGQ APRLLIYGAATRATGIPARVS GSGSGTEFTLTISSLQSEDFAV YYCQQYNNWPLTFGGGTKVE IKRTVAAPSVFIFPPSDEQLKS GTASVVCLLNNFYPREAKVQ WKVDNALQSGNSQESVTEQD SKDSTYSLSSTLTLSKADYEK HKVYACEVTHQGLSSPVTKSF NRGEC (SEQ ID NO: 3700) |

TABLE 8-continued

| anti-GIPR antibodies and GLP-1/anti-GIPR antibody fusion polypeptides | |
|---|---|
| PL-48080 | EIVMTQSPATLSVSPGERATLS CRASQSVSSNLAWYQQKPGQ APRLLIYGAATRATGIPARVS GSGSGTEFTLTISSLQSEDFAV YYCQQYNNWPLTFGGGTKVE IKRTVAAPSVFIFPPSDEQLKS GTASVVCLLNNFYPREAKVQ WKVDNALQSGNSQESVTEQD SKDSTYSLSSTLTLSKADYEK HKVYACEVTHQGLSSPVTKSF NRGEC (SEQ ID NO: 3701) |
| PL-45564 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3702) |
| PL-45565 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3703) |
| PL-45565<br>PL-45566 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3704) |
| PL-45567<br>PL-45568 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3705) |
| PL-45569 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3706) |
| PL-45570 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK |

TABLE 8-continued

| anti-GIPR antibodies and GLP-1/anti-GIPR antibody fusion polypeptides | |
|---|---|
| | RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3707) |
| PL-45571 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3708) |
| PL-45572 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3709) |
| PL-47264 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYCCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3710) |
| PL-47265 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYCCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3711) |
| PL-47266 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYCCQQAHR FPPTFGEGTKVEIRRTVAAPSV FIFPPSDEQLKSGTASVVCLLN NFYPREAKVQWKVDNALQS GNSQESVTEQDSKDSTYSLES TLTLSKADYEKHKVYACEVT HQGLSSPVTKSFNRGEC (SEQ ID NO: 3712) |
| PL-47267 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY |

TABLE 8-continued

| anti-GIPR antibodies and GLP-1/anti-GIPR antibody fusion polypeptides | |
|---|---|
| | TASSLQSEVPSRFSGSGSGTDF TLTISSLQPEDFAIYYCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3713) |
| PL-47268 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYYCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3714) |
| PL-47269 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYYCQQAHR FPPTFGEGTKVEIRRTVAAPSV FIFPPSDEQLKSGTASVVCLLN NFYPREAKVQWKVDNALQS GNSQESVTEQDSKDSTYSLES TLTLSKADYEKHKVYACEVT HQGLSSPVTKSFNRGEC (SEQ ID NO: 3715) |
| PL-47270 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYSCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3716) |
| PL-47271 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYSCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3717) |
| PL-47272 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYSCQQAHR FPPTFGEGTKVEIRRTVAAPSV FIFPPSDEQLKSGTASVVCLLN NFYPREAKVQWKVDNALQS GNSQESVTEQDSKDSTYSLES TLTLSKADYEKHKVYACEVT HQGLSSPVTKSFNRGEC (SEQ ID NO: 3718) |

TABLE 8-continued

| anti-GIPR antibodies and GLP-1/anti-GIPR antibody fusion polypeptides | |
|---|---|
| PL-47273 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYCCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3719) |
| PL-47274 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYCCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3720) |
| PL-47275 | LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYCCQQAHR FPPTFGEGTKVEIRRTVAAPSV VFIFPPSDEQLKSGTASVVCLLN NNFYPREAKVQWKVDNALQS SGNSQESVTEQDSKDSTYSLES STLTLSKADYEKHKVYACEVT THQGLSSPVTKSFNRGEC (SEQ ID NO: 3721) |
| PL-47276 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYYCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3722) |
| PL-47277 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYYCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3723) |
| PL-47278 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYYCQQAHR FPPTFGEGTKVEIRRTVAAPSV |

TABLE 8-continued

| anti-GIPR antibodies and GLP-1/anti-GIPR antibody fusion polypeptides | |
|---|---|
| | FIFPPSDEQLKSGTASVVCLLN NFYPREAKVQWKVDNALQS GNSQESVTEQDSKDSTYSLES TLTLSKADYEKHKVYACEVT HQGLSSPVTKSFNRGEC (SEQ ID NO: 3724) |
| PL-47279 | HGEGTFTSDLSKQMEEEAVR LFAAQAAQQGGGGSGSATGG SGSVASSGSGSATGSAIQMTQ SPSSVSASIGDRVTITCRASQN INNLLAWYQQKPGKAPKLLIY TASSLQSEVPSRFSGSGSGTDF TLTISSLQPEDFAIYSCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3725) |
| PL-47280 | HGEGTFTSDLSKQMEEEAVR LFAAQAAQQGGGGSGSATGG SGSVASSGSGSATGSAIQMTQ SPSSVSASIGDRVTITCRASQN INNLLAWYQEKPGKAPKLLIY TASSLQSEVPSRFSGSGSGTDF TLTISSLQPEDFAIYSCQQAHR FPPTFGQGTKVEIRRTVAAPS VFIFPPSDEQLKSGTASVVCLL NNFYPREAKVQWKVDNALQ SGNSQESVTEQDSKDSTYSLE STLTLSKADYEKHKVYACEV THQGLSSPVTKSFNRGEC (SEQ ID NO: 3726) |
| PL-47281 | HGEGTFTSDLSKQMEEEAVRLFAAQAAQQGGGGSGSATGGSGSVA SSGSGSATGSAIQMTQSPSSVSASIGDRVTITCRASQNINNLLAWYQ QKPGKAPKLLIYTASSLQSEVPSRFSGSGSGTDFTLTISSLQPEDFAIY SCQQAHRFPPTFGEGTKVEIRRTVAAPSVFIFPPSDEQLKSGTASVVC LLNNFYPREAKVQWKVDNALQSGNSQESVTEQDSKDSTYSLESTLT LSKADYEKHKVYACEVTHQGLSSPVTKSFNRGEC (SEQ ID NO: 3727) |
| PL-46633 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3728) |
| PL-46634 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3729) |
| PL-46635 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3730) |

TABLE 8-continued

| anti-GIPR antibodies and GLP-1/anti-GIPR antibody fusion polypeptides | |
|---|---|
| PL-46636 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3731) |
| PL-46637 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3732) |
| PL-46638 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3733) |
| PL-46639 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3734) |
| PL-46640 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3735) |
| PL-46641 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3736) |
| PL-46642 | QVQLVESGGGVVQPGRSLRLSCAASGFTFSNYGMHWVRQAPGEGL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV |

TABLE 8-continued

| anti-GIPR antibodies and GLP-1/anti-GIPR antibody fusion polypeptides | |
|---|---|
| | KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3737) |
| PL-46643 | QVQLVESGGGVVQPGRSLRLSCAASGFTFSNYGMHWVRQAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3738) |
| PL-46644 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3739) |
| PL-46645 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3740) |
| PL-46646 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3741) |
| PL-46647 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3742) |
| PL-46648 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3743) |

TABLE 8-continued

| anti-GIPR antibodies and GLP-1/anti-GIPR antibody fusion polypeptides | |
|---|---|
| PL-46649 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3744) |
| PL-46650 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3745) |
| PL-46651 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3746) |
| PL-46652 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3747) |
| PL-46653 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3748) |
| PL-46654 | QVQLVESGGGVVQPGRSLRLSCAASGFTFSNYGMHWVREAPGEGL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV<br>KFNWYVDGVEVHNAKTKPCEEQYGSTYRCVSVLTVLHQDWLNGK<br>EYKCKVSNKALPAPIEKTISKAKGQPREPQVYTLPPSRKEMTKNQVS<br>LTCLVKGFYPSDIAVEWESNGQPENNYKTTPPVLKSDGSFFLYSKLT<br>VDKSRWQQGNVFSCSVMHEALHNHYTQKSLSLSPGK<br>(SEQ ID NO: 3749) |
| PL-46655 | QVQLVESGGGVVQPGRSLRLSCAASGFTFSNYGMHWVRQAPGEEL<br>EWVAAIWFDASDKYYADAVKGRFTISRDNSKNTLYLQMNSLRAED<br>TAVYYCARDQAIFGVVPDYWGQGTLVTVSSASTKGPSVFPLAPSSK<br>STSGGTAALGCLVKDYFPEPVTVSWNSGALTSGVHTFPAVLQSSGL<br>YSLESVVTVPSSSLGTQTYICNVNHKPSNTKVDKKVEPKSCDKTHT<br>CPPCPAPELLGGPSVFLFPPKPKDTLMISRTPEVTCVVVDVSHEDPEV |

TABLE 8-continued

| anti-GIPR antibodies and GLP-1/anti-GIPR antibody fusion polypeptides | |
|---|---|
| | KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3750) |
| PL-46656 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3751) |
| PL-46657 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3752) |
| PL-46658 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3753) |
| PL-46659 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3754) |
| PL-46660 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3755) |
| PL-46661 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3756) |

TABLE 8-continued

| anti-GIPR antibodies and GLP-1/anti-GIPR antibody fusion polypeptides | |
|---|---|
| PL-46662 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3757) |
| PL-46663 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3758) |
| PL-46664 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKGSFFLYSKLT VDKSRWQQGNVFSCSVMHEALHNHYTQKSLSLSPGK (SEQ ID NO: 3759) |
| PL-46665 | QVQLVESGGGVVQPGRSLRLSCAASGFTFSNYGMHWVRQAPGEEL EWVAAIWFDASDKYYADAVKGRFTISRDNSKNTLYLQMNSLRAED TAVYYCARDQAIFGVVPDYWGQGTLVTVSSASTKGPSVFPLAPSSK STSGGTAALGCLVKDYFPEPVTVSWNSGALTSGVHTFPAVLQSSGL YSLESVVTVPSSSLGTQTYICNVNHKPSNTKVDKKVEPKSCDKTHT CPPCPAPELLGGPSVFLFPPKPKDTLMISRTPEVTCVVVDVSHEDPEV KFNWYVDGVEVHNAKTKPCEEQYGSTYRCVSVLTVLHQDWLNGK EYKCKVSNKALPAPIEKTISKAKGQPREPQVYTLPPSRKEMTKNQVS LTCLVKGFYPSDIAVEWESNGQPENNYKTTPPVLKSDGSFFLYSKLT VDKSRWQQGNVFSCSVMHEALHNHYTQKSLSLSPGK (SEQ ID NO: 3760) |
| PL-47505 | EIVMTQSPATLSVSPGERATLS CRASQSVSSNLAWYQQKPGQ APRLLIYGAATRATGIPARFSG SGSGTEFTLTISSLEPEDFAVY YCQQYNNFPLTFGGGTKVEIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3761) |
| PL-47368 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3762) |
| PL-47369 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT |

TABLE 8-continued

| anti-GIPR antibodies and GLP-1/anti-GIPR antibody fusion polypeptides | |
|---|---|
| | ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3763) |
| PL-47370 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3764) |
| PL-47371 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3765) |
| PL-47372 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3766) |
| PL-47373 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3767) |
| PL-47374 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3768) |
| PL-47375 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3769) |

TABLE 8-continued

| anti-GIPR antibodies and GLP-1/anti-GIPR antibody fusion polypeptides | |
|---|---|
| PL-47376 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3770) |
| PL-47377 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3771) |
| PL-47378 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3772) |
| PL-47379 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3773) |
| PL-47380 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3774) |
| PL-47381 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3775) |
| PL-47382 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT |

TABLE 8-continued

| anti-GIPR antibodies and GLP-1/anti-GIPR antibody fusion polypeptides | |
|---|---|
| | ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3776) |
| PL-47383 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3777) |
| PL-48488 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3778) |
| PL-47384 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3779) |
| PL-47385 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3780) |
| PL-47386 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3781) |
| PL-47387 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3782) |

TABLE 8-continued

| anti-GIPR antibodies and GLP-1/anti-GIPR antibody fusion polypeptides | |
|---|---|
| PL-47388 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3783) |
| PL-47389 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3784) |
| PL-47390 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3785) |
| PL-47391 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3786) |
| PL-47392 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3787) |
| PL-47393 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3788) |
| PL-47394 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT |

TABLE 8-continued

| anti-GIPR antibodies and GLP-1/anti-GIPR antibody fusion polypeptides | |
|---|---|
| | ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3789) |
| PL-47395 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3790) |
| PL-47396 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3791) |
| PL-47397 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3792) |
| PL-47398 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3793) |
| PL-47399 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3794) |
| PL-47400 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3795) |

TABLE 8-continued

| anti-GIPR antibodies and GLP-1/anti-GIPR antibody fusion polypeptides | |
|---|---|
| PL-47401 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3796) |
| PL-47402 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3797) |
| PL-47403 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3798) |
| PL-48489 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3799) |
| PL-47404 | DIQMTQSPSSLSASIGDRVTIT CRASQDIRDYLGWYQQKPGK APKRLIYGASSLQSGVPSRFSG SGSGTEFTLTISSLQPEDFATY YCLQHNNYPFTFGPGTKVDIK RTVAAPSVFIFPPSDEQLKSGT ASVVCLLNNFYPREAKVQWK VDNALQSGNSQESVTEQDSK DSTYSLSSTLTLSKADYEKHK VYACEVTHQGLSSPVTKSFNR GEC (SEQ ID NO: 3800) |
| PL-47405 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3801) |
| PL-47406 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3802) |

TABLE 8-continued

| anti-GIPR antibodies and GLP-1/anti-GIPR antibody fusion polypeptides | |
|---|---|
| PL-47407 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3803) |
| PL-47408 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3804) |
| PL-47409 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3805) |
| PL-47410 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3806) |
| PL-47411 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3807) |
| PL-47412 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3808) |
| PL-47413 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3809) |
| PL-47414 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3810) |
| PL-47415 | DIQMTQSPSSLSASIGDRVTITCRASQDIR DYLGWYQQKPGKAPKRLIYGASSLQSG VPSRFSGSGSGTEFTLTISSLQPEDFATYY |

TABLE 8-continued

| anti-GIPR antibodies and GLP-1/anti-GIPR antibody fusion polypeptides | |
|---|---|
| | CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3811) |
| PL-47416 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3812) |
| PL-47417 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3813) |
| PL-47418 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3814) |
| PL-47419 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3815) |
| PL-47420 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3816) |
| PL-47421 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3817) |
| PL-47422 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3818) |
| PL-47423 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3819) |

TABLE 8-continued

| anti-GIPR antibodies and GLP-1/anti-GIPR antibody fusion polypeptides | |
|---|---|
| PL-48490 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3820) |
| PL-47424 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3821) |
| PL-47425 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3822) |
| PL-47426 | DIQMTQSPSSLSASIGDRVTITCRASQDIR DYLGWYQQKPGKAPKRLIYGASSLQSG VPSRFSGSGSGTEFTLTISSLQPEDFATYY CLQHNNYPFTFGPGTKVDIKRTVAAPSV FIFPPSDEQLKSGTASVVCLLNNFYPREA KVQWKVDNALQSGNSQESVTEQDSKDS TYSLSSTLTLSKADYEKHKVYACEVTHQ (SEQ ID NO: 3823) |
| PL-50123 PL-50581 PL-51747 PL-51763 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3824) |
| PL-50155 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3825) |
| PL-50124 PL-50582 PL-51748 PL-51764 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3826) |
| PL-50156 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3827) |
| PL-50157 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA |

TABLE 8-continued

| anti-GIPR antibodies and GLP-1/anti-GIPR antibody fusion polypeptides | |
|---|---|
| | KVQWKVDNALQSGNSQESVTEQDSKDS TYSLSSTLTLSKADYEKHKVYACEVTHQ GLSSPVTKSFNRGEC (SEQ ID NO: 3828) |
| PL-50159 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3829) |
| PL-50125 PL-50583 PL-51749 PL-51765 | QVQLVESGGGVVQPGRSLRLSCAASGFTFSNYGMHWVRQAPG EGLEWVAAIWFDASDKYYADAVKGRFTISRDNSKNTLYLQMN SLRAEDTAVYYCARDQAIFGVVPDYWGQGTLVTVSSASTKGPS VFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPCEEQYGS TYRCVSVLTVLHQDWLNGKEYKCKVSNKALPAPIEKTISKAKG QPREPQVYTLPPSREEMTKNQVSLTCLVKGFYPSDIAVEWESNG QPENNYKFIVPVLDSDGSFFLYSKLTVDKSRWQQGNVFSCSVM HEALHNHYTQKSLSLSPGK (SEQ ID NO: 3830) |
| PL-50160 | QVQLVESGGGVVQPGRSLRLSCAASGFTFSNYGMHWVRQAPG EGLEWVAAIWFDASDKYYADAVKGRFTISRDNSKNTLYLQMN SLRAEDTAVYYCARDQAIFGVVPDYWGQGTLVTVSSASTKGPS VFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPCEEQYGS TYRCVSVLTVLHQDWLNGKEYKCKVSNKALPAPIEKTISKAKG QPREPQVYTLPPSREEMTKNQVSLTCLVKGFYPSDIAVEWESNG QPENNYKFIVPVLDSDGSFFLYSKLTVDKSRWQQGNVFSCSVM HEALHNHYTQKSLSLSPGK (SEQ ID NO: 3831) |
| PL-50126 PL-50584 PL-51750 PL-51766 PL-54099 | QVQLVESGGGVVQPGRSLRLSCAASGFTFSNYGMHWVRQAPG EGLEWVAAIWFDASDKYYADAVKGRFTISRDNSKNTLYLQMN SLRAEDTAVYYCARDQAIFGVVPDYWGQGTLVTVSSASTKGPS VFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPCEEQYGS TYRCVSVLTVLHQDWLNGKEYKCKVSNKALPAPIEKTISKAKG QPREPQVYTLPPSREEMTKNQVSLTCLVKGFYPSDIAVEWESNG QPENNYKFIVPVLDSDGSFFLYSKLTVDKSRWQQGNVFSCSVM HEALHNHYTQKSLSLSPGK (SEQ ID NO: 3832) |
| PL-50161 | QVQLVESGGGVVQPGRSLRLSCAASGFTFSNYGMHWVRQAPG EGLEWVAAIWFDASDKYYADAVKGRFTISRDNSKNTLYLQMN SLRAEDTAVYYCARDQAIFGVVPDYWGQGTLVTVSSASTKGPS VFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPCEEQYGS TYRCVSVLTVLHQDWLNGKEYKCKVSNKALPAPIEKTISKAKG QPREPQVYTLPPSREEMTKNQVSLTCLVKGFYPSDIAVEWESNG QPENNYKFIVPVLDSDGSFFLYSKLTVDKSRWQQGNVFSCSVM HEALHNHYTQKSLSLSPGK (SEQ ID NO: 3833) |
| PL-50163 | QVQLVESGGGVVQPGRSLRLSCAASGFTFSNYGMHWVRQAPG EGLEWVAAIWFDASDKYYADAVKGRFTISRDNSKNTLYLQMN SLRAEDTAVYYCARDQAIFGVVPDYWGQGTLVTVSSASTKGPS VFPLAPSSKSTSGGTAALGCLVKDYFPEPVTVSWNSGALTSGV HTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPCEEQYGS TYRCVSVLTVLHQDWLNGKEYKCKVSNKALPAPIEKTISKAKG QPREPQVYTLPPSREEMTKNQVSLTCLVKGFYPSDIAVEWESNG QPENNYKFIVPVLDSDGSFFLYSKLTVDKSRWQQGNVFSCSVM HEALHNHYTQKSLSLSPGK (SEQ ID NO: 3834) |
| PL-50165 | QVQLVESGGGVVQPGRSLRLSCAASGFTFSNYGMHWVRQAPGE GLEWVAAIWFDASDKYYADAVKGRFTISRDNSKNTLYLQMNSL RAEDTAVYYCARDQAIFGVVPDYWGQGTLVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKKV |

TABLE 8-continued

| anti-GIPR antibodies and GLP-1/anti-GIPR antibody fusion polypeptides | |
|---|---|
| | EPKSCDKTHTCPPCPAPELLGGPSVFLFPPKPKDTLMISRTPEVTC VVVDVSHEDPEVKFNWYVDGVEVHNAKTKPCEEQYGSTYRCV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGK (SEQ ID NO: 3835) |
| PL-50511 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP GAVTVAWKADSSPVKAGVETTTPSKQS NNKYAASSYLSLTPEQWKSHRSYSCQVT HEGSTVEKTVAPTECS (SEQ ID NO: 3836) |
| PL-50512 | QMQVVQSGAEVKKPGASVKVSCKASGYTFTGYYMHWVRQAP GQGLEWMGWINPNSGGTNYAQKFQGRVTMTRDTSISTAYMEL SSLRSDDTAVYYCARGGDYVFGTYRPHYYYGMDVWGQGTTV TVSSASTKGPSVFPLAPSSKSTSGGTAALGCLVKDYFPEPVTVS WNSGALTSGVHTFPAVLQSSGLYSLSSVVTVPSSSLGTQTYICN VNHKPSNTKVDKKVEPKSCDKTHTCPPCPAPELLGGPSVFLFPP KPKDTLMISRTPEVTCVVVDVSHEDPEVKFNWYVDGVEVHNA KTKPCEEQYGSTYRCVSVLTVLHQDWLNGKEYKCKVSNKALP APIEKTISKAKGQPREPQVYTLPPSREEMTKNQVSLTCLVKGFY PSDIAVEWESNGQPENNYKTTPPVLDSDGSFFLYSKLTVDKSR WQQGNVFSCSVMHEALHNHYTQKSLSLSPGK (SEQ ID NO: 3837) |
| PL-50513 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP GAVTVAWKADSSPVKAGVETTTPSKQS NNKYAASSYLSLTPEQWKSHRSYSCQVT HEGSTVEKTVAPTECS (SEQ ID NO: 3838) |
| PL-50514 | QMQVVQSGAEVKKPGASVKVSCKASGYTFTGYYMHWV RQAPGQGLEWMGWINPNSGGTNYAQKFQGRVTMTRDT SISTAYMELSSLRSDDTAVYYCARGGDYVFGTYRPHYYY GMDVWGQGTTVTVSSASTKGPSVFPLAPSSKSTSGGTAA LGCLVKDYFPEPVTVSWNSGALTSGVHTFPAVLQSSGLY SLSSVVTVPSSSLGTQTYICNVNHKPSNTKVDKKVEPKSC DKTHTCPPCPAPELLGGPSVFLFPPKPKDTLMISRTPEVTC VVVDVSHEDPEVKFNWYVDGVEVHNAKTKPCEEQYGST YRCVSVLTVLHQDWLNGKEYKCKVSNKALPAPIEKTISK AKGQPREPQVYTLPPSREEMTKNQVSLTCLVKGFYPSDIA VEWESNGQPENNYKTTPPVLDSDGSFFLYSKLTVDKSRW QQGNVFSCSVMHEALHNHYTQKSLSLSPGK (SEQ ID NO: 3839) |
| PL-50515 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP GAVTVAWKADSSPVKAGVETTTPSKQS NNKYAASSYLSLTPEQWKSHRSYSCQVT HEGSTVEKTVAPTECS (SEQ ID NO: 3840) |
| PL-50516 | QMQVVQSGAEVKKPGASVKVSCKASGYTFTGYYMHWVRQAPGQ GLEWMGWINPNSGGTNYAQKFQGRVTMTRDTSISTAYMELSSLRS DDTAVYYCARGGDYVFGTYRPHYYYGMDVWGQGTTVTVSSAST KGPSVFPLAPSSKSTSGGTAALGCLVKDYFPEPVTVSWNSGALTSG VHIFYAVLQSSGLYSLSSVVTVPSSSLGTQTYICNVNHKPSNTKVD KKVEPKSCDKTHTCPPCPAPELLGGPSVFLFPPKPKDTLMISRTPEV TCVVVDVSHEDPEVKFNWYVDGVEVHNAKTKPCEEQYGSTYRCV SVLTVLHQDWLNGKEYKCKVSNKALPAPIEKTISKAKGQPREPQV YTLPPSREEMTKNQVSLTCLVKGFYPSDIAVEWESNGQPENNYKT TPPVLDSDGSFFLYSKLTVDKSRWQQGNVFSCSVMHEALHNHYTQ KSLSLSPGK (SEQ ID NO: 3841) |
| PL-50517 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP |

TABLE 8-continued

| anti-GIPR antibodies and GLP-1/anti-GIPR antibody fusion polypeptides | |
|---|---|
| | GAVTVAWKADSSPVKAGVETTTPSKQS NNKYAASSYLSLTPEQWKSHRSYSCQVT HEGSTVEKTVAPTECS (SEQ ID NO: 3842) |
| PL-50518 | QMQVVQSGAEVKKPGASVKVSCKASGYTFTGYYMHWVRQAP GQGLEWMGWINPNSGGTNYAQKFQGRVTMTRDTSISTAYMELS SLRSDDTAVYYCARGGDYVFGTYRPHYYYGMDVWGQGTTVTV SSASTKGPSVFPLAPSSKSTSGGTAALGCLVKDYFPEPVTVSWNS GALTSGVHIFYAVLQSSGLYSLSSVVTVPSSSLGTQTYICNVNHK PSNTKVDKKVEPKSCDKTHTCPPCPAPELLGGPSVFLFPPKPKDT LMISRTPEVTCVVVDVSHEDPEVKFNWYVDGVEVHNAKTKPCE EQYGSTYRCVSVLTVLHQDWLNGKEYKCKVSNKALPAPIEKTIS KAKGQPREPQVYTLPPSREEMTKNQVSLTCLVKGFYPSDIAVEW ESNGQPENNYKTTPPVLDSDGSFFLYSKLTVDKSRWQQGNVFSC SVMHEALHNHYTQKSLSLSPGK (SEQ ID NO: 3843) |
| PL-50519 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP GAVTVAWKADSSPVKAGVETTTPSKQS NNKYAASSYLSLTPEQWKSHRSYSCQVT HEGSTVEKTVAPTECS (SEQ ID NO: 3844) |
| PL-50520 | QMQVVQSGAEVKKPGASVKVSCKASGYTFTGYYMHWVRQAPGQ GLEWMGWINPNSGGTNYAQKFQGRVTMTRDTSISTAYMELSSLRS DDTAVYYCARGGDYVFGTYRPHYYYGMDVWGQGTTVTVSSAST KGPSVFPLAPSSKSTSGGTAALGCLVKDYFPEPVTVSWNSGALTSG VHTFPAVLQSSGLYSLSSVVTVPSSSLGTQTYICNVNHKPSNTKVD KKVEPKSCDKTHTCPPCPAPELLGGPSVFLFPPKPKDTLMISRTPEV TCVVVDVSHEDPEVKFNWYVDGVEVHNAKTKPCEEQYGSTYRCV SVLTVLHQDWLNGKEYKCKVSNKALPAPIEKTISKAKGQPREPQV YTLPPSREEMTKNQVSLTCLVKGFYPSDIAVEWESNGQPENNYKT TPPVLDSDGSFFLYSKLTVDKSRWQQGNVFSCSVMHEALHNHYTQ KSLSLSPGK (SEQ ID NO: 3845) |
| PL-50521 | QSVLTQPPSASGTPGQRVTISCSGSSSNIG SNYVNWYQHLPGTAPKLLIYTNNQRPSG VPDRFSGSKSGTSASLAISGLQSEDEADY FCATFDSSLNAPVFGGGTKLTVLGQPKA APSVTLFPPSSEELQANKATLVCLISDFYP GAVTVAWKADSSPVKAGVETTTPSKQS NNKYAASSYLSLTPEQWKSHRSYSCQVT HEGSTVEKTVAPTECS (SEQ ID NO: 3846) |
| PL-50522 | QMQVVQSGAEVKKPGASVKVSCKASGYTFTGYYMHWVRQAPGQ GLEWMGWINPNSGGTNYAQKFQGRVTMTRDTSISTAYMELSSLRS DDTAVYYCARGGDYVFGTYRPHYYYGMDVWGQGTTVTVSSAST KGPSVFPLAPSSKSTSGGTAALGCLVKDYFPEPVTVSWNSGALTSG VHIFYAVLQSSGLYSLSSVVTVPSSSLGTQTYICNVNHKPSNTKVD KKVEPKSCDKTHTCPPCPAPELLGGPSVFLFPPKPKDTLMISRTPEV TCVVVDVSHEDPEVKFNWYVDGVEVHNAKTKPCEEQYGSTYRCV SVLTVLHQDWLNGKEYKCKVSNKALPAPIEKTISKAKGQPREPQV YTLPPSREEMTKNQVSLTCLVKGFYPSDIAVEWESNGQPENNYKT TPPVLDSDGSFFLYSKLTVDKSRWQQGNVFSCSVMHEALHNHYTQ KSLSLSPGK (SEQ ID NO: 3847) |
| PL-50523 PL-53170 | DIQLTQSPSSLSASVGDRVTITCRASQTIS RFLNWYQQKPGKAPELLIYVASSLQSGV PSRFSGSGSGTDFTLTISSLQPEDFATYYC QQSYSTLISFGQGTKLEITRTVAAPSVFIF PPSDEQLKSGTASVVCLLNNFYPREAKV QWKVDNALQSGNSQESVTEQDSKDSTY SLSSTLTLSKADYEKHKVYACEVTHQGL SSPVTKSFNRGEC (SEQ ID NO: 3848) |
| PL-50524 PL-53167 | QVQLVESGGGVVQPGRSLRLSCTASGFTFSSYGIHWVRQAPGKG LEWVAVIWYDGSNKFHADSVKGRFTISRDNSKNTLYLQMNSLRA EDSAMYFCARGKVAGMPEAFEIWGQGTKVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPKS CDKTHTCPPCPAPELLGGPSVFLFPPKPKDTLMISRTPEVTCVVVD VSHEDPEVKFNWYVDGVEVHNAKTKPCEEQYGSTYRCVSVLTV LHQDWLNGKEYKCKVSNKALPAPIEKTISKAKGQPREPQVYTLPP SREEMTKNQVSLTCLVKGFYPSDIAVEWESNGQPENNYKTTPPVL DSDGSFFLYSKLTVDKSRWQQGNVFSCSVMHEALHNHYTQKSLS LSPGK (SEQ ID NO: 3849) |

TABLE 8-continued

| anti-GIPR antibodies and GLP-1/anti-GIPR antibody fusion polypeptides | |
|---|---|
| PL-50525 | DIQLTQSPSSLSASVGDRVTITCRASQTIS RFLNWYQQKPGKAPELLIYVASSLQSGV PSRFSGSGSGTDFTLTISSLQPEDFATYYC QQSYSTLISFGQGTKLEITRTVAAPSVFIF PPSDEQLKSGTASVVCLLNNFYPREAKV QWKVDNALQSGNSQESVTEQDSKDSTY SLSSTLTLSKADYEKHKVYACEVTHQGL SSPVTKSFNRGEC (SEQ ID NO: 3850) |
| PL-50526 | QVQLVESGGGVVQPGRSLRLSCTASGFTFSSYGIHWVRQ APGKGLEWVAVIWYDGSNKFHADSVKGRFTISRDNSKN TLYLQMNSLRAEDSAMYFCARGKVAGMPEAFEIWGQGT KVTVSSASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCP APELLGGPSVFLFPPKPKDTLMISRTPEVTCVVVDVSHED PEVKFNWYVDGVEVHNAKTKPCEEQYGSTYRCVSVLTV LHQDWLNGKEYKCKVSNKALPAPIEKTISKAKGQPREPQ VYTLPPSREEMTKNQVSLTCLVKGFYPSDIAVEWESNGQ PENNYKTTPPVLDSDGSFFLYSKLTVDKSRWQQGNVFSC SVMHEALHNHYTQKSLSLSPGK (SEQ ID NO: 3851) |
| PL-50527<br>PL-53168 | DIQLTQSPSSLSASVGDRVTIT CRASQTISRFLNWYQQKPGK APELLIYVASSLQSGVPSRFSG SGSGTDFTLTISSLQPEDFATY YCQQSYSTLISFGQGTKLEITR TVAAPSVFIFPPSDEQLKSGTA SVVCLLNNFYPREAKVQWKV DNALQSGNSQESVTEQDSKD STYSLSSTLTLSKADYEKHKV YACEVTHQGLSSPVTKSFNRG EC (SEQ ID NO: 3852) |
| PL-50528<br>PL-53169 | QVQLVESGGGVVQPGRSLRLSCTASGFTFSSYGIHWVRQAPGKG LEWVAVIWYDGSNKFHADSVKGRFTISRDNSKNTLYLQMNSLR AEDSAMYFCARGKVAGMPEAFEIWGQGTKVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPCEEQYGSTYRCV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGK (SEQ ID NO: 3853) |
| PL-50529 | DIQLTQSPSSLSASVGDRVTITCRASQTIS RFLNWYQQKPGKAPELLIYVASSLQSGV PSRFSGSGSGTDFTLTISSLQPEDFATYYC QQSYSTLISFGQGTKLEITRTVAAPSVFIF PPSDEQLKSGTASVVCLLNNFYPREAKV QWKVDNALQSGNSQESVTEQDSKDSTY SLSSTLTLSKADYEKHKVYACEVTHQGL SSPVTKSFNRGEC (SEQ ID NO: 3854) |
| PL-50530 | QVQLVESGGGVVQPGRSLRLSCTASGFTFSSYGIHWVRQAPG KGLEWVAVIWYDGSNKFHADSVKGRFTISRDNSKNTLYLQM NSLRAEDSAMYFCARGKVAGMPEAFEIWGQGTKVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPSN TKVDKKVEPKSCDKTHTCPPCPAPELLGGPSVFLFPPKPKDTL MISRTPEVTCVVVDVSHEDPEVKFNWYVDGVEVHNAKTKPC EEQYGSTYRCVSVLTVLHQDWLNGKEYKCKVSNKALPAPIEK TISKAKGQPREPQVYTLPPSREEMTKNQVSLTCLVKGFYPSDIA VEWESNGQPENNYKTTPPVLDSDGSFFLYSKLTVDKSRWQQG NVFSCSVMHEALHNHYTQKSLSLSPGK (SEQ ID NO: 3855) |
| PL-50531 | DIQLTQSPSSLSASVGDRVTITCRASQTIS RFLNWYQQKPGKAPELLIYVASSLQSGV PSRFSGSGSGTDFTLTISSLQPEDFATYYC QQSYSTLISFGQGTKLEITRTVAAPSVFIF PPSDEQLKSGTASVVCLLNNFYPREAKV QWKVDNALQSGNSQESVTEQDSKDSTY SLSSTLTLSKADYEKHKVYACEVTHQGL SSPVTKSFNRGEC (SEQ ID NO: 3856) |

TABLE 8-continued

| anti-GIPR antibodies and GLP-1/anti-GIPR antibody fusion polypeptides | |
|---|---|
| PL-50532 | QVQLVESGGGVVQPGRSLRLSCTASGFTFSSYGIHWVRQAPGKG LEWVAVIWYDGSNKFHADSVKGRFTISRDNSKNTLYLQMNSLR AEDSAMYFCARGKVAGMPEAFEIWGQGTKVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPCEEQYGSTYRCV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGK (SEQ ID NO: 3857) |
| PL-50533 | DIQLTQSPSSLSASVGDRVTITCRASQTIS RFLNWYQQKPGKAPELLIYVASSLQSGV PSRFSGSGSGTDFTLTISSLQPEDFATYYC QQSYSTLISFGQGTKLEITRTVAAPSVFIF PPSDEQLKSGTASVVCLLNNFYPREAKV QWKVDNALQSGNSQESVTEQDSKDSTY SLSSTLTLSKADYEKHKVYACEVTHQGL SSPVTKSFNRGEC (SEQ ID NO: 3858) |
| PL-50534 | QVQLVESGGGVVQPGRSLRLSCTASGFTFSSYGIHWVRQAPGKG LEWVAVIWYDGSNKFHADSVKGRFTISRDNSKNTLYLQMNSLRA EDSAMYFCARGKVAGMPEAFEIWGQGTKVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPKS CDKTHTCPPCPAPELLGGPSVFLFPPKPKDTLMISRTPEVTCVVVD VSHEDPEVKFNWYVDGVEVHNAKTKPCEEQYGSTYRCVSVLTV LHQDWLNGKEYKCKVSNKALPAPIEKTISKAKGQPREPQVYTLPP SREEMTKNQVSLTCLVKGFYPSDIAVEWESNGQPENNYKTTPPVL DSDGSFFLYSKLTVDKSRWQQGNVFSCSVMHEALHNHYTQKSLS LSPGK (SEQ ID NO: 3859) |
| PL-51752 PL-51753 PL-51768 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ GLSSPVTKSFNRGEC (SEQ ID NO: 3860) |
| PL-51754 PL-51761 | QVQLVESGGGVVQPGRSLRLSCAASGFTFSNYGMHWVRQAPGE GLEWVAAIWFDASDKYYADAVKGRFTISRDNSKNTLYLQMNSL RAEDTAVYYCARDQAIFGVVPDYWGQGTLVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPCEEQYGSTYRCV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGK (SEQ ID NO: 3861) |
| PL-51751 PL-51756 PL-51767 | EIVMTQSPATLSVSPGERATLSCRASQSV SSNLAWYQQKPGQAPRLLIYGAATRATG IPARVSGSGSGTEFTLTISSLQSEDFAVYY CQQYNNWPLTFGGGTKVEIKRTVAAPSV FIFPPSDEQLKSGTASVVCLLNNFYPREA KVQWKVDNALQSGNSQESVTEQDSKDS TYSLSSTLTLSKADYEKHKVYACEVTHQ (SEQ ID NO: 3862) |
| PL-51757 PL-51762 | QVQLVESGGGVVQPGRSLRLSCAASGFTFSNYGM HWVRQAPGEGLEWVAAIWFDASDKYYADAVKGR FTISRDNSKNTLYLQMNSLRAEDTAVYYCARDQAI FGVVPDYWGQGTLVTVSSASTKGPSVFPLAPSSKS TSGGTAALGCLVKDYFPEPVTVSWNSGALTSGVHT FPAVLQSSGLYSLSSVVTVPSSSLGTQTYICNVNHK PSNTKVDKKVEPKSCDKTHTCPPCPAPELLGGPSVF LFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPRE PQVYTLPPSREEMTKNQVSLTCLVKGFYPSDIAVE WESNGQPENNYKTTPPVLDSDGSFFLYSKLTVDKS RWQQGNVFSCSVMHEALHNHYTQKSLSLSPGK (SEQ ID NO: 3863) |

TABLE 8-continued

| anti-GIPR antibodies and GLP-1/anti-GIPR antibody fusion polypeptides | |
|---|---|
| PL-50353<br>PL-50366 | EIVMTQSPATLSVSPGERATLSCRASQSV<br>SSNLAWYQQKPGQAPRLLIYGAATRATG<br>IPARVSGSGSGTEFTLTISSLQSEDFAVYY<br>CQQYNNWPLTFGGGTKVEIKRTVAAPSV<br>FIFPPSDEQLKSGTASVVCLLNNFYPREA<br>KVQWKVDNALQSGNSQESVTEQDSKDS<br>TYSLSSTLTLSKADYEKHKVYACEVTHQ<br>GLSSPVTKSFNRGEC (SEQ ID NO: 3864) |
| PL-50354<br>PL-50367 | QVQLVESGGGVVQPGRSLRLSCAASGFTFSNYGMHW<br>VRQAPGEGLEWVAAIWFDASDKYYADAVKGRFTISR<br>DNSKNTLYLQMNSLRAEDTAVYYCARDQAIFGVVPD<br>YWGQGTLVTVSSASTKGPSVFPLAPSSKSTSGGTAAL<br>GCLVKDYFPEPVTVSWNSGALTSGVHTFPAVLQSSGL<br>YSLSSVVTVPSSSLGTQTYICNVNHKPSNTKVDKKVEP<br>KSCDKTHTCPPCPAPELLGGPSVFLFPPKPKDTLMISRT<br>PEVTCVVVDVSHEDPEVKFNWYVDGVEVHNAKTKPC<br>EEQYGSTYRCVSVLTVLHQDWLNGKEYKCKVSNKAL<br>PAPIEKTISKAKGQPREPQVYTLPPSREEMTKNQVSLT<br>CLVKGFYPSDIAVEWESNGQPENNYKTTPPVLDSDGS<br>FFLYSKLTVDKSRWQQGNVFSCSVMHEALHNHYTQK<br>SLSLSPGK (SEQ ID NO: 3865) |
| PL-50355<br>PL-50368 | EIVMTQSPATLSVSPGERATLS<br>CRASQSVSSNLAWYQQKPGQ<br>APRLLIYGAATRATGIPARVS<br>GSGSGTEFTLTISSLQSEDFAV<br>YYCQQYNNWPLTFGGGTKVE<br>IKRTVAAPSVFIFPPSDEQLKS<br>GTASVVCLLNNFYPREAKVQ<br>WKVDNALQSGNSQESVTEQD<br>SKDSTYSLSSTLTLSKADYEK<br>HKVYACEVTHQGLSSPVTKSF<br>NRGEC (SEQ ID NO: 3866) |
| PL-50356<br>PL-50369 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3867) |
| PL-50357<br>PL-50370 | EIVMTQSPATLSVSPGERATLS<br>CRASQSVSSNLAWYQQKPGQ<br>APRLLIYGAATRATGIPARVS<br>GSGSGTEFTLTISSLQSEDFAV<br>YYCQQYNNWPLTFGGGTKVE<br>IKRTVAAPSVFIFPPSDEQLKS<br>GTASVVCLLNNFYPREAKVQ<br>WKVDNALQSGNSQESVTEQD<br>SKDSTYSLSSTLTLSKADYEK<br>HKVYACEVTHQGLSSPVTKSF<br>NRGEC (SEQ ID NO: 3868) |
| PL-50358<br>PL-50371 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3869) |
| PL-50359<br>PL-50372 | EIVMTQSPATLSVSPGERATLS<br>CRASQSVSSNLAWYQQKPGQ<br>APRLLIYGAATRATGIPARVS<br>GSGSGTEFTLTISSLQSEDFAV<br>YYCQQYNNWPLTFGGGTKVE<br>IKRTVAAPSVFIFPPSDEQLKS<br>GTASVVCLLNNFYPREAKVQ<br>WKVDNALQSGNSQESVTEQD |

TABLE 8-continued

| anti-GIPR antibodies and GLP-1/anti-GIPR antibody fusion polypeptides | |
|---|---|
| | SKDSTYSLSSTLTLSKADYEK<br>HKVYACEVTHQGLSSPVTKSF<br>NRGEC (SEQ ID NO: 3870) |
| PL-50360<br>PL-50373 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3871) |
| PL-50361<br>PL-50374 | EIVMTQSPATLSVSPGERATLS<br>CRASQSVSSNLAWYQQKPGQ<br>APRLLIYGAATRATGIPARVS<br>GSGSGTEFTLTISSLQSEDFAV<br>YYCQQYNNWPLTFGGGTKVE<br>IKRTVAAPSVFIFPPSDEQLKS<br>GTASVVCLLNNFYPREAKVQ<br>WKVDNALQSGNSQESVTEQD<br>SKDSTYSLSSTLTLSKADYEK<br>HKVYACEVTHQGLSSPVTKSF<br>NRGEC (SEQ ID NO: 3872) |
| PL-50362 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3873) |
| PL-50363 | EIVMTQSPATLSVSPGERATLS<br>CRASQSVSSNLAWYQQKPGQ<br>APRLLIYGAATRATGIPARVS<br>GSGSGTEFTLTISSLQSEDFAV<br>YYCQQYNNWPLTFGGGTKVE<br>IKRTVAAPSVFIFPPSDEQLKS<br>GTASVVCLLNNFYPREAKVQ<br>WKVDNALQSGNSQESVTEQD<br>SKDSTYSLSSTLTLSKADYEK<br>HKVYACEVTHQGLSSPVTKSF<br>NRGEC (SEQ ID NO: 3874) |
| PL-50364 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3875) |
| PL-54037 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDQAIFGVVPDYWGQGTLVTVSSASTKGPSVFPLAPSSKSTSGGT<br>AALGCLVKDYFPEPVTVSWNSGALTSGVHTFPAVLQSSGLYSLSSVVT<br>VPSSSLGTQTYICNVNHKPSNTKVDKKVEPKSCDKTHTCPPCPAPELLG<br>GPSVFLFPPKPKDTLMISRTPEVTCVVVDVSHEDPEVKFNWYVDGVEV<br>HNAKTKPCEEQYGSTYRCVSVLTVLHQDWLNGKEYKCKVSNKALPAP<br>IEKTISKAKGQPREPQVYTLPPSREEMTKNQVSLTCLVKGFYPSDIAVE<br>WESNGQPENNYKTTPPVLDSDGSFFLYSKLTVDKSRWQQGNVFSCSV<br>MHEALHNHYTQKSLSLSPGK (SEQ ID NO: 3876) |
| PL-54100 | QVQLVESGGGVVQPGRSLRLSCAASGFTFSNYGMHWVRQAPGEGLEW<br>VAAIWFDASDKYYADAVKGRFTISRDNSKNTLYLQMNSLRAEDTAVY<br>YCARDLAIFGVVPDYWGQGTLVTVSSASTKGPSVFPLAPSSKSTSGGTA<br>ALGCLVKDYFPEPVTVSWNSGALTSGVHITPAVLQSSGLYSLSSVVTV<br>PSSSLGTQTYICNVNHKPSNTKVDKKVEPKSCDKTHTCPPCPAPELLGG<br>PSVFLFPPKPKDTLMISRTPEVTCVVVDVSHEDPEVKFNWYVDGVEVH |

TABLE 8-continued

| anti-GIPR antibodies and GLP-1/anti-GIPR antibody fusion polypeptides | |
|---|---|
| | NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3877) |
| PL-54101 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3878) |
| PL-54039 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3879) |
| PL-54040 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3880) |
| PL-54032 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3881) |
| PL-54034 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3882) |
| PL-54102 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3883) |
| PL-54035 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI |

TABLE 8-continued

| anti-GIPR antibodies and GLP-1/anti-GIPR antibody fusion polypeptides | |
|---|---|
| | EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3884) |
| PL-54036 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3885) |
| PL-54047 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3886) |
| PL-54049 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3887) |
| PL-54050 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3888) |
| PL-54051 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3889) |
| PL-54052 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3890) |
| PL-54041 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV |

TABLE 8-continued

| anti-GIPR antibodies and GLP-1/anti-GIPR antibody fusion polypeptides | |
|---|---|
| | HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3891) |
| PL-54043 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3892) |
| PL-54044 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3893) |
| PL-54045 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3894) |
| PL-54046 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3895) |
| PL-54059 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3896) |
| PL-54061 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3897) |
| PL-54062 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP |

TABLE 8-continued

| anti-GIPR antibodies and GLP-1/anti-GIPR antibody fusion polypeptides | |
|---|---|
| | IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3898) |
| PL-54063 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3899) |
| PL-54064 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3900) |
| PL-54053 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3901) |
| PL-54055 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3902) |
| PL-54056 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3903) |
| PL-54057 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3904) |
| PL-54058 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH |

TABLE 8-continued

| anti-GIPR antibodies and GLP-1/anti-GIPR antibody fusion polypeptides | |
|---|---|
| | NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3905) |
| PL-54071 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3906) |
| PL-54073 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3907) |
| PL-54074 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3908) |
| PL-54075 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHIFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3909) |
| PL-54076 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHIFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3910) |
| PL-54065 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3911) |
| PL-54067 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI |

TABLE 8-continued

| anti-GIPR antibodies and GLP-1/anti-GIPR antibody fusion polypeptides | |
|---|---|
| | EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3912) |
| PL-54068 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3913) |
| PL-54069 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3914) |
| PL-54070 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3915) |
| PL-54083 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3916) |
| PL-54085 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3917) |
| PL-54086 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3918) |
| PL-54087 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH |

TABLE 8-continued

| anti-GIPR antibodies and GLP-1/anti-GIPR antibody fusion polypeptides | |
|---|---|
| | NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3919) |
| PL-54088 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3920) |
| PL-54077 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3921) |
| PL-54079 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3922) |
| PL-54080 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3923) |
| PL-54081 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3924) |
| PL-54082 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3925) |
| PL-54094 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP |

TABLE 8-continued

| anti-GIPR antibodies and GLP-1/anti-GIPR antibody fusion polypeptides | |
|---|---|
| | IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3926) |
| PL-54096 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHITPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3927) |
| PL-54097 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3928) |
| PL-54098 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3929) |
| PL-54103 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3930) |
| PL-54089 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEV HNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVE WESNGQPENNYKTTPPVLDSDGSFFLYSKLTVDKSRWQQGNVFSCSV MHEALHNHYTQKSLSLSPGK (SEQ ID NO: 3931) |
| PL-54091 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3932) |
| PL-54092 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDQAIFGVVPDYWGQGTLVTVSSASTKGPSVFPLAPSSKSTSGGT AALGCLVKDYFPEPVTVSWNSGALTSGVHTFPAVLQSSGLYSLSSVVT VPSSSLGTQTYICNVNHKPSNTKVDKKVEPKSCDKTHTCPPCPAPELLG |

TABLE 8-continued

| anti-GIPR antibodies and GLP-1/anti-GIPR antibody fusion polypeptides | |
|---|---|
| | GPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3933) |
| PL-54093 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3934) |
| PL-54104 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3935) |
| PL-54038 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3936) |
| PL-54033 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3937) |
| PL-54048 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3938) |
| PL-54042 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 3939) |
| PL-54060 | QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVH |

TABLE 8-continued

| anti-GIPR antibodies and GLP-1/anti-GIPR antibody fusion polypeptides | |
|---|---|
| | NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3940) |
| PL-54054 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3941) |
| PL-54072 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3942) |
| PL-54066 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3943) |
| PL-54084 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3944) |
| PL-54078 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3945) |
| PL-54095 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI EKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMH EALHNHYTQKSLSLSPGK (SEQ ID NO: 3946) |
| PL-54090 | QVQLVESGGGVVQPGRSLRLSCAASGFTFSNYGMHWVRQAPGEGLEW VAAIWFDASDKYYADAVKGRFTISRDNSKNTLYLQMNSLRAEDTAVY YCARDLAIFGVVPDYWGQGTLVTVSSASTKGPSVFPLAPSSKSTSGGTA ALGCLVKDYFPEPVTVSWNSGALTSGVHTFPAVLQSSGLYSLSSVVTV PSSSLGTQTYICNVNHKPSNTKVDKKVEPKSCDKTHTCPPCPAPELLGG PSVFLFPPKPKDTLMISRTPEVTCVVVDVSHEDPEVKFNWYVDGVEVH NAKTKPCEEQYGSTYRCVSVLTVLHQDWLNGKEYKCKVSNKALPAPI |

TABLE 8-continued

| anti-GIPR antibodies and GLP-1/anti-GIPR antibody fusion polypeptides | |
|---|---|
| | EKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMH<br>EALHNHYTQKSLSLSPGK (SEQ ID NO: 3947) |

Transient Expression

GLP1 GIPR mAb fusion polypeptides of which the first 22 amino acids are the VK1 signal peptide) were transiently expressed in HEK 293-6E cells at $1.5\times10^6$ cells/ml, transfected with 0.5 mg/L DNA (0.1 mg/L GLP1 GIPR in pTT5 vector with 0.4 mg/L empty pTT5 vector) (Durocher et al. NRCC, Nucleic Acids. Res. (2002) 30, e9) with 4 ml PEI/mg DNA in F17 media (Thermo Fisher). Yeastolate and Glucose were added to cultures 1 hour after transfection. Cells were grown in suspension in F17 expression medium supplemented with 0.1% Kolliphor, 6 mM L-Glutamine and 50 μg/ml Geneticin for 6 days and harvested for purification.

Stable Expression

GLP1 GIPR mAb fusion polypeptides of which the first 22 amino acids are the VK1 signal peptide) were stably expressed in suspension adapted CHO-K1 cells with the corresponding cDNAs. Transfections were performed using Lipofectamine LTX (Thermo Fisher) according to the manufacturer's protocol. Briefly, a total of 30-36 μg of the mammalian expression plasmid DNA was used at a 1:1 ratio for the antibody fusion dimer. For each, the plasmid DNA was added to 3-4 ml OPTI-MEM (Thermo Fisher) and mixed. In a separate tubes, 72-75 μl Lipofectamine LTX was added to 3-4 ml OPTI-MEM. The solutions were then incubated for 5 minutes at room temperature. To form the transfection complex, the DNA and Lipofectamine LTX mixtures for each were combined and incubated at room temperature for an additional 20 minutes.

Log phase CHO-K1 cells were pelleted by centrifugation (1200-1500 RPM for 5 minutes), washed one time with 1×PBS (Thermo Fisher) and resuspended to $1.5\text{-}2\times10^6$ viable cells/mL in OPTI-MEM. For each transfection, 5-6 mL of the washed cells were added to a 125 mL volume shake flask. The DNA transfection complex was then added to the cells. The flasks were incubated at 36° C. with 5% $CO_2$, shaking at 150 RPM for 6 hours. To stop the transfection, 9-12 ml growth media was added to each flask, and cells were incubated for 48 to 72 hours.

To begin selection, cells were pelleted by centrifugation (1200-1500 RPM for 5 minutes) 72 hours post-transfection and, the media was replaced with 23-25 mL of growth media supplemented with antibiotics. Selection media was changed 2-3 times per week, diluting cultures when needed to ensure cultures did not over-grow ($\leq 5\text{-}6\times10^6$ vc/mL), until cell viability and density recovered.

Large scale productions (2.3 L-2.5 L) were carried out in shake flasks at 36° C. Productions were seeded at $2\times10^6$ vc/mL in production media. Conditioned media was harvested on day 5 by centrifugation followed by filtration (0.45 μm).

Purification

Cell culture media containing recombinantly expressed anti-GIPR antibody GLP1 fusions were loaded directly onto MabSelect SuRE (MSS) columns. Following loading, each MSS column was washed with 5 column volumes of 25 mM Tris-HCl, 100 mM Sodium Chloride, pH 7.4. The MSS column was further washed with 3 column volumes of 25 mM Tri-HCl, 500 mM L-Arginine, pH 7.5 and then washed with an additional 5 column volume of Tris-HCl, 100 mM Sodium Chloride, pH 7.4. Finally, the bound anti GIPR antibody GLP1 fusion molecules were eluted with 100 mM Sodium Acetate, pH 3.6. The MSS elutions were collected in sterile containers and immediately titrated with 2 M Tris-Base, pH 9.2 to a final pH of 5.8. The pH adjusted MSS elutions were filtered with 0.2 μm PES membrane for the next step which was cation exchange purification.

The pH adjusted MSS elution pools were loaded onto a cation exchange column SP Sepharose HP (SP HP) equilibrated with 20 mM 2-morpholin-4-ium-4-ylethanesulfonate (MES), pH 6.2. The column was washed with 3 column volumes of 20 mM MES, pH 6.2 and then the bound proteins were eluted with a linear gradient (20 column volume gradient from 0 to 140 mM sodium chloride, then an additional 10 column volume gradient from 140 mM sodium chloride to 160 mM sodium chloride). Following the linear gradient, the remaining bound material was removed by step elution of 20 mM MES, 400 mM sodium chloride, pH 6.2. Alternatively, for some constructs a 20 column volume gradient of 0) to 160 mM NaCl or 0 to 240 mM NaCl in 20 mM MES, pH 6.2 were used to eluted the bound protein. The UV-VIS threshold of 50 or 100 mAU was set for the collection of 0.25 column volume fractions for 1 to 53 ml columns and 0.05 column volume fractions for 245 ml columns. The purity of the cation exchange fractions were evaluated by analytical size exclusion, Caliper micro-capillary electrophoresis (Perkin Elmer) and mass spectrophotometry. The cation exchange fractions selected for the highest purity and yield were pooled and filtered with 0.2 μm MES membrane filter. The SP HP pools were buffer exchanged with 10 mM Potassium Phosphate, 160 mM L-Arginine, pH 6.0 and concentrated to the desired concentration with 30 kDa molecular cut off PES membrane. The formulated pools were filtered with 0.2 μm PES membrane and then stored at −80° C. Examples of the final yield and purity by size exclusion chromatography is shown in FIGS. 4 and 9.

GLP-1 Agonist Activity

CHOK1 cells stably expressing the human GLP-IR were used to measure peptide or recombinant fusion-induced cAMP production in a homogeneous time-resolved fluorescence (HTRF) assay according to the manufacturer's instructions (CISBIO, cat #62AM4PEJ). Serial diluted peptides or recombinant fusions were incubated with 40,000 cells in assay buffer (0.1% BSA, 500 uM IBMX in F12 media) for 15 min at 37° C. Cells were then lysed with lysis buffer containing cAMP-d2 and cAMP cryptate (CISBIO) and incubated for 1 hour at room temperature before being measured in Evision plate reader (PerkinElmer). The CAMP levels were expressed as a fluorescence ratio of 665/620 nm. The GLP-1 activity assessments of both synthetic peptides is shown in FIGS. 1 and 2. The GLP-1 activity assessments of the recombinant molecules is shown in FIGS. 4, 9, 14, 15, 16, 17, 19, 23 and 29.

GIPR Antagonist Activity

HEK 293T cells stably expressing the human GIPR were used to measure peptide or recombinant fusion-induced cAMP generation in HTRF assay according to the manufacturer's instructions (Cisbio, cat #62AM4PEJ). Serial diluted recombinant fusions or GIPR antibody were incubated with 30,000 cells in assay buffer (0.1% BSA, 500 uM IBMX in F12 media) for 30 min at 37° C. before treatment with GIP at final concentration of 0.05 nM. Cells were incubated for 30 min at 37° C., and then lysed in lysis buffer containing CAMP-d2 and cAMP cryptate (CISBIO) for 1 hour at room temperature. The fluorescence was measured in Evision plate reader (PerkinElmer) and the CAMP levels are expressed as a ratio of 665/620 nm. The GIPR antagonist activity assessments of the recombinant molecules is shown in FIGS. 4, 9, 14, 15, 16, 17, 19, 23 and 29.

Pharmacokinetic Studies

Preliminary pharmacokinetic (PK) studies were conducted with CD-1 mice. The general design of the PK studies is outlined in FIGS. 26 and 30. GIPR-GLP1 bispecific fusion constructs were dosed to Male CD-1 mice by intravenous bolus administration. Blood samples were taken at each time point post-dose. All plasma specimens were stored at approximately −70° C. (+10° C.) until transferred for subsequent analysis.

For LC-MS/MS, fusion construct stock solutions (1 mg/mL) were made from reference standards in A5Su buffer and stored at −70° C. 1 mg/mL fusion construct stock solutions were used to prepare 100 μg/mL working solution in A5Su buffer and were stored in a refrigerator at 2 to 8° C. Standard samples were prepared in CD-1 mouse plasma. Standards concentrations of 100, 250, 500, 1000, 2500, 5000 and 10,000 ng/ml were prepared by serial dilution of a freshly prepared 10,000 ng/mL solution in mouse plasma using the 100 μg/mL fusion construct working solution. 25 μl mouse plasma samples were aliquoted into the appropriate well of a 96-well plate, followed by the addition of 25 μL of magnetic beads immobilized with anti-human Fc capture antibody Ab35. Samples were then incubated for 60 min at room temperature. After washing with 250 mM $NH_4HCO_3$ buffer, the beads were denatured using 8 M urea and reduced by tris(2-carboxyethyl) phosphine (TCEP), and followed by trypsin digestion. After quenched with formic acid, samples were centrifuged and the supernatant was transferred to a 96-well plate then injected (10 μL) onto the LC-MS/MS system for analysis.

The LC-MS/MS consisted of an Acquity UPLC system (Waters, Milford, MA) coupled to a 5500 QTRAP mass spectrometer (AB Sciex, Toronto, Canada) with a Turbo IonSpray® ionization source. The analytical column was an Acquity UPLC BEH C18 column (2.1 mm×100 mm). The mobile phases were 0.1% formic acid in water (mobile phase A) and 0.1% formic acid in acetonitrile (mobile phase B). Data was collected and processed using AB Sciex Analyst® software (version 1.5).

The calibration curve was derived from the peak area ratios (fusion construct tryptic surrogate peptide/internal standard) versus the concentrations of the corresponding fusion construct standards using $1/x^2$ weighted linear least-squares regression. The regression equations from the calibration standards was used to back calculate the measured concentrations for each standard and plasma samples.

Two Assays for GIPr-GLP1 Fusion Constructs

Intact Fusion Assay:

Immunoprecipitation capture/detection: Ab 35 (anti-huFc)-GLP1 N-term peptide

Total Antibody Assay:

Immunoprecipitation capture/detection: Ab 35 (anti-huFc)-huFc peptide

Noncompartmental analysis was performed on individual mouse plasma concentration-nominal time data using Phoenix® WinNonlin® (version 6.4: Certara, Princeton, NJ). Individual concentration values less than the lower limit of qualification (LLOQ, 250 ng/mL) were reported as below the quantitation limit (BQL) and set to zero for the calculation of summary statistics. Mean concentration values less than the LLOQ were not reported or plotted. All concentrations values less than the LLOQ were excluded from the noncompartmental analysis. Nominal doses and nominal sampling times were used for PK analysis.

The Following PK Parameters were Estimated:

The initial concentration (Co) value after intravenous administration was estimated by back extrapolation to time zero using the first 2 observed declining concentration values.

The area under the concentration-time curve from time zero to infinity (AUCinf) was calculated by the linear trapezoidal method.

The terminal-phase half-life ($t_{1/2,z}$) was calculated as $\ln 2/\lambda_z$. $\lambda_z$ is the first-order rate constant of drug associated with the terminal portion of the curve.

Systemic clearance (CL) was calculated as:

$$CL = \text{Dose}/\text{AUCinf after intravenous administration}$$

The pharmacokinetic properties of a select set of the recombinant molecules is shown in FIGS. 7, 12, 20, 21, 22, 24, 27, 31 and 37.

In Vivo Pharmacodynamic Studies

Diabetic mice were selected primarily to screen for GLP-1 activity of our bispecific molecules. Molecules were selected based on their potential to reduce plasma glucose levels at different time points post injection. In addition, body weight loss or inhibition of body weight gain was also measured indicative of GLP-1 activity, GIPR inhibition, or a combination of both, either from co-administration of each or from the bispecific molecule. Diet-induced obese mice (DIO) were also used as a model to measure weight loss effects from treatment with different molecules.

Male db/db mice (#642) were obtained from Jackson Laboratories (Bar Harbor, ME) and delivered at 8-9 weeks of age. Upon arrival, mice were group-housed at four per cage and maintained in controlled environmental conditions with 12 hour light (6:30 AM-6:30 PM) and dark cycles (6:30 PM-6:30 AM). Mice were fed a standard rodent chow diet (20/20× Harlan Teklad) with free-access to drinking water.

Mice were acclimated to environment conditions for one to two weeks. Prior to dosing, mice were handled and body weight measurements were taken. One day prior to dosing, conscious mice were bled from the retro-orbital sinus for plasma glucose measurement using a handheld AlphaTrak glucometer designed for rodent plasma (Zoetis, Parsippany, New Jersey). On the day of dosing, baseline plasma glucose and body weight measurements were taken. The cage mean for plasma glucose and body weight were used to stratify cages into treatment groups. Mice were maintained in their home cages. Following administration of test article, plasma glucose was measured at various time points at (3 and 6 hr) and plasma glucose and body weight measurements were taken every 24 hrs thereafter. Plasma glucose levels were measured until levels returned to near baseline levels and body weight measurements were taken until the rate of body weight gain was similar to Vehicle-treated control group. Results of the body weight studies for a select set of the recombinant molecules is shown in FIGS. 5, 6, 10 and 11.

Figures 36A, 36B:
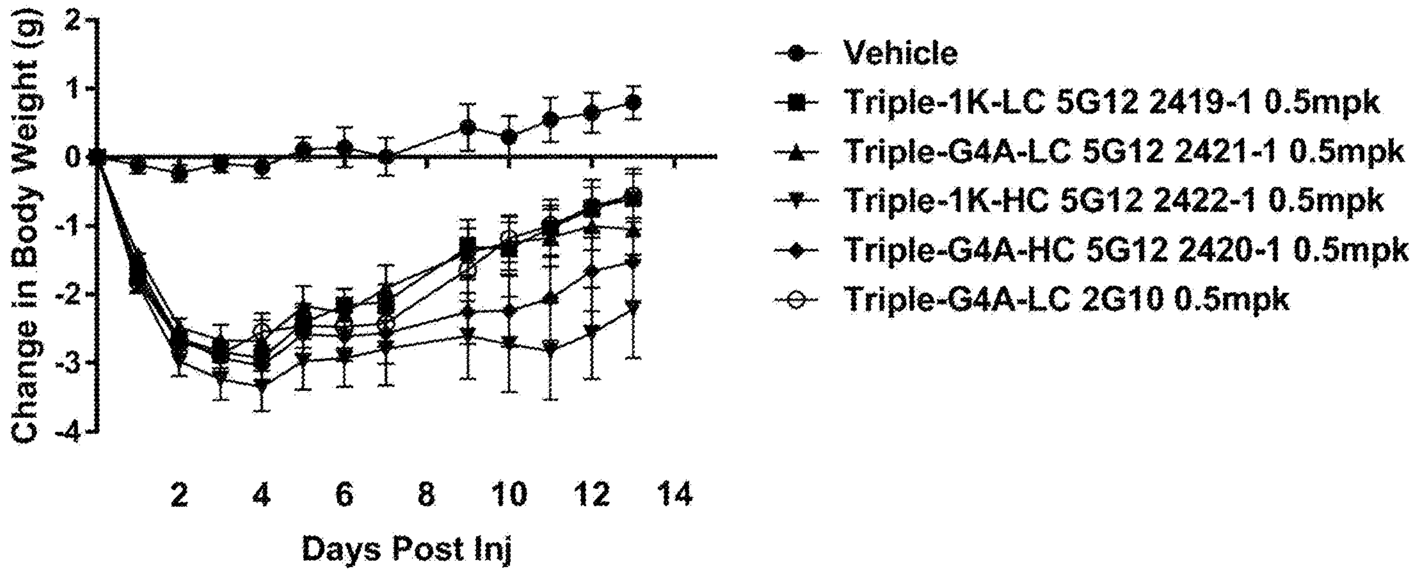
FIG. 36A-36B: GLP1-GIPR Activity In Vivo 5G12 Ab Single Injection
Figures 37A, 37B:
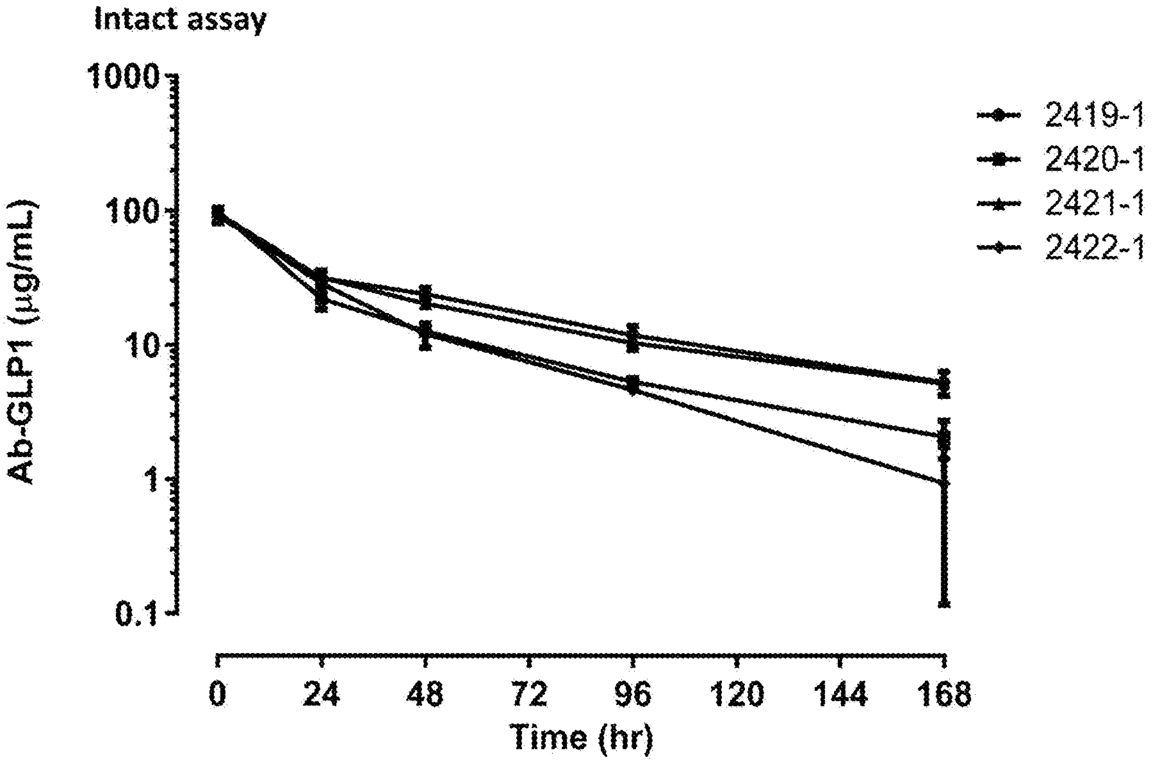
FIG. 37A-37D: Concentration-time data and PK parameters
Figures 37C, 37D:
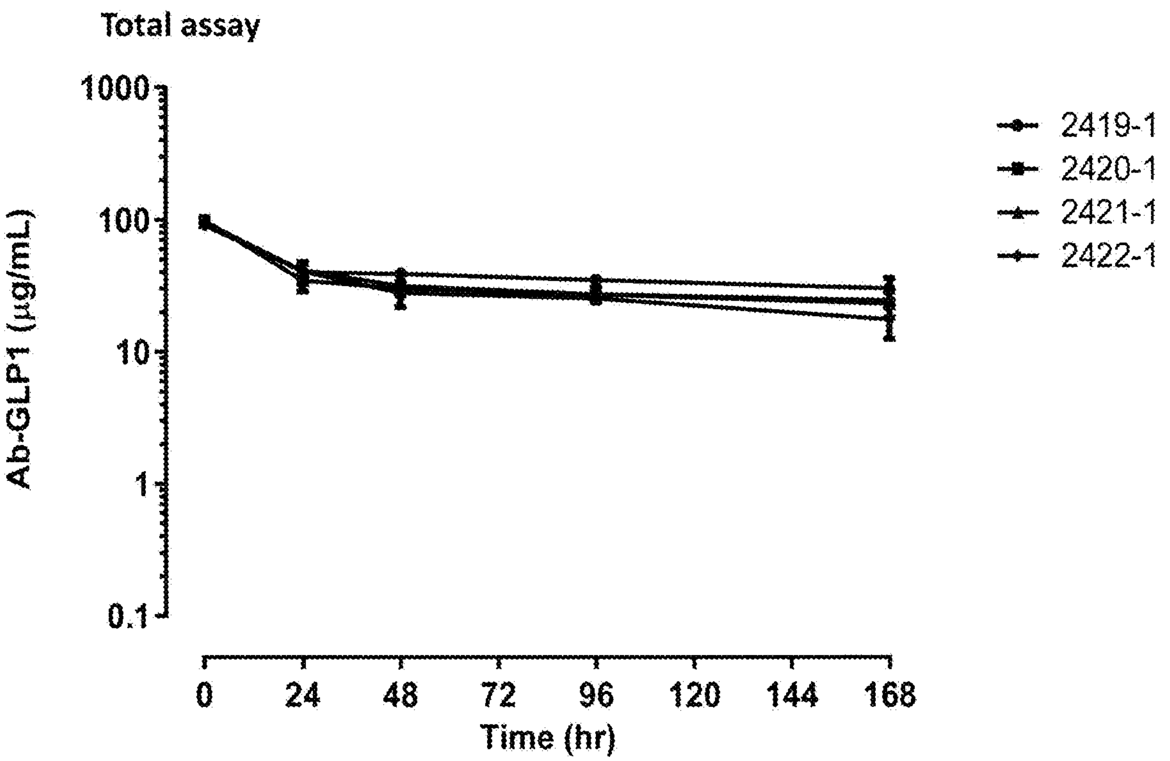

A single study was performed using DIO mice. Male DIO mice (#380050) were obtained from Jackson Laboratories (Bar Harbor, ME) and delivered at 18 weeks of age and 12 weeks on high-fat diet (HFD: D12492, Research Diets, New Brunswick, NJ). Mice were single-housed and acclimated for an additional 5 weeks. The objective of this study was to confirm GIPR Ab effect when fused with GLP-1 at different sites and with different linkers. Since the GLP-1 peptide is the same across all the molecules, the greatest and most sustained body weight loss effect would indicate retention of GIPR Ab activity when fused with GLP-1. The screen molecules were tested with a GIPR Ab that cross-reacts in mice. A different GIPR Ab 2G10) that is minimally active in mice was also used as a negative control. Any of our molecules that behaved like the 2G10 fused GIPR Ab would indicate that our fusion molecule adversely affected GIPR Ab activity. Mice were treated with a single injection of Vehicle, or various bispecific fusion molecules dosed at 0.5 mg/kg. These molecules all consisted of various combinations of the same GLP-1 peptide fused to either the heavy or light chain of GIPR Ab 5G12 by 1 of 2 possible linkers. Body weight was measured daily until body weights began to rebound back to baseline levels. Results of the body weight study for a select set of the recombinant molecules is shown in FIG. 36.

Figure 32:
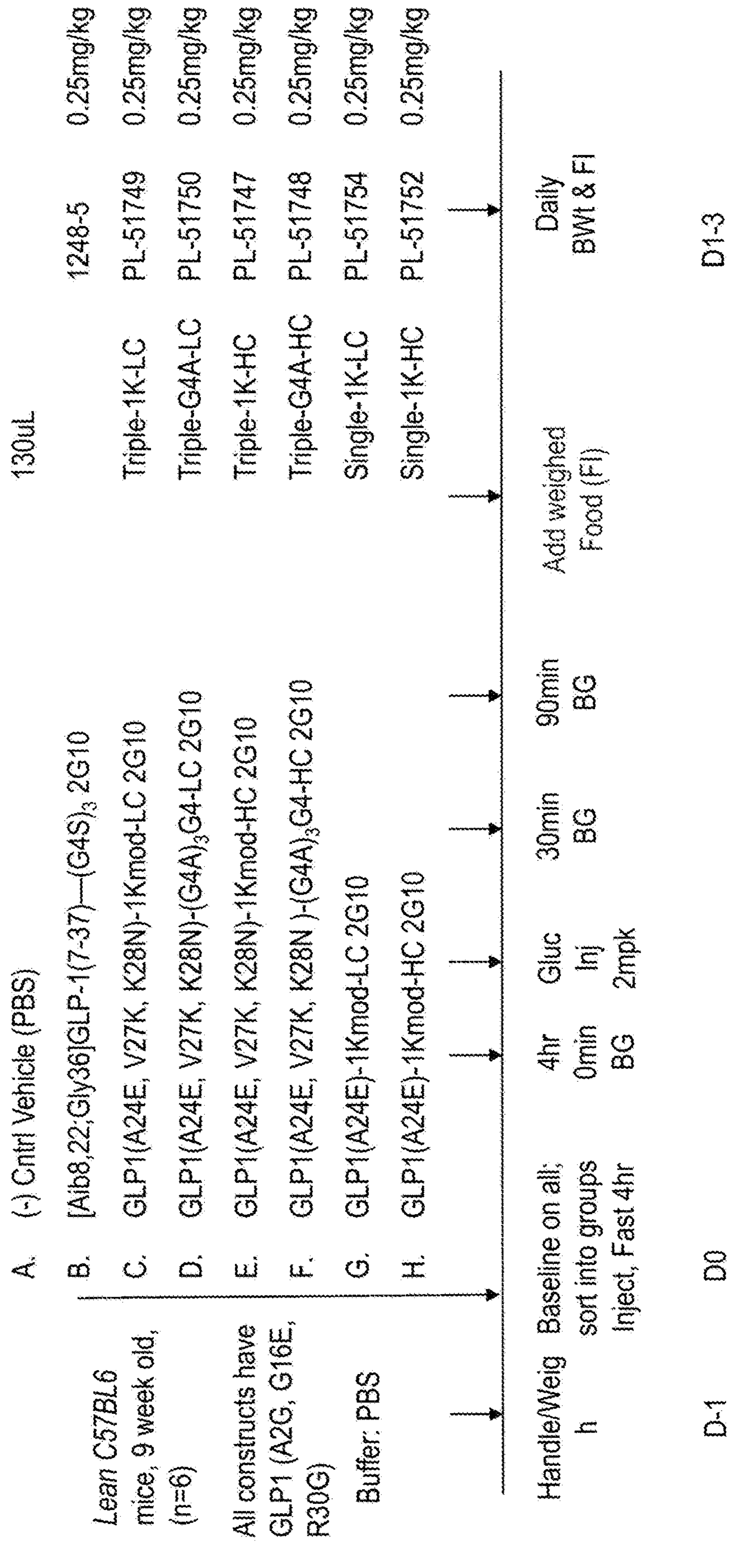
FIG. 32: Study design to confirm potency of triple mutants on glp-1 activity
Figure 34:
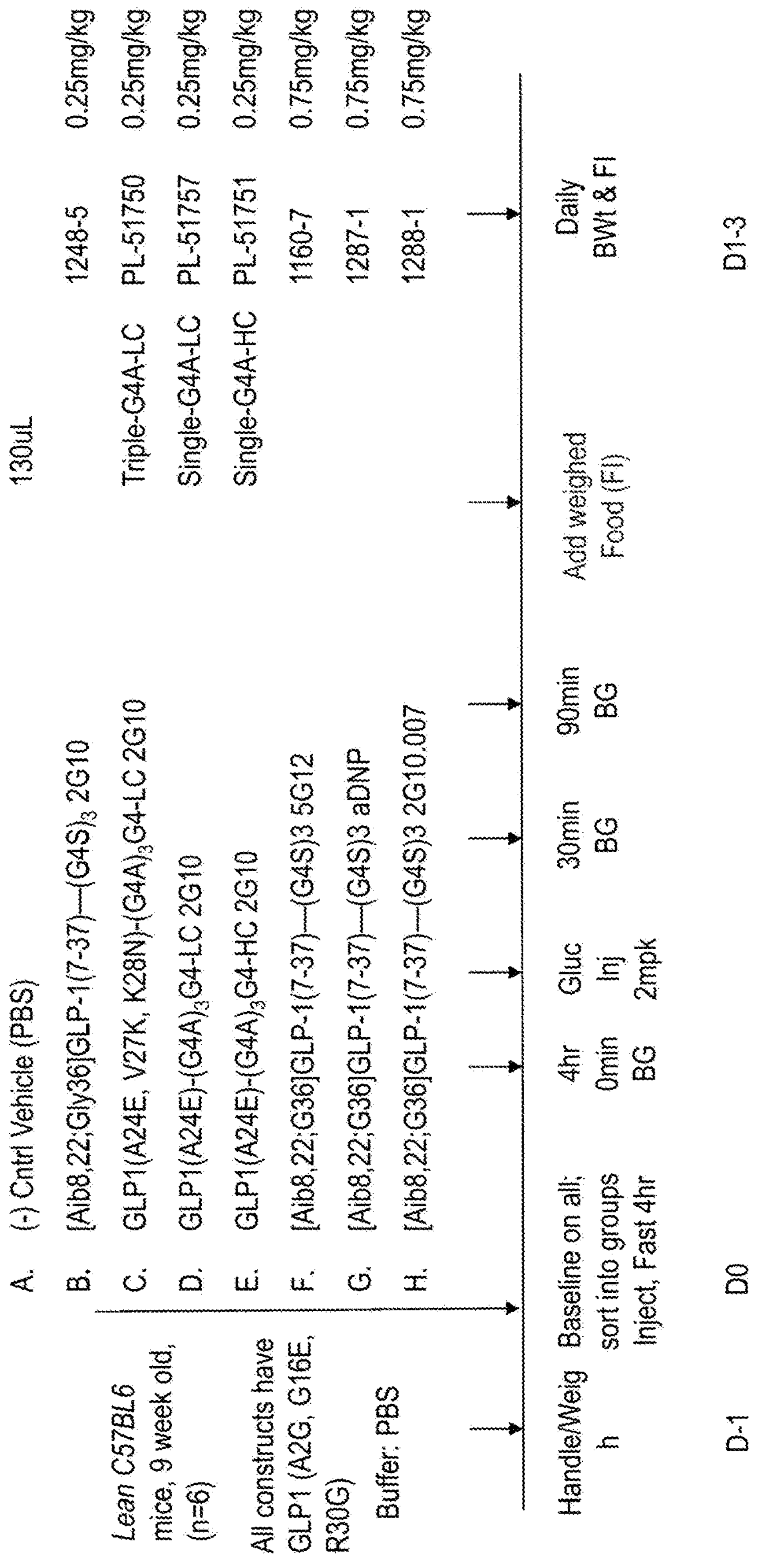
FIG. 34: Study design to confirm potency of single mutants on glp-1 activity

In an effort to modulate and screen the GLP-1 potency of various bispecific molecules, C57BL6 mice were selected to run acute glucose tolerance tests (IPGTT) following administration of the bispecific molecule as outlined in FIGS. 32 and 34. C57BL6 mice were obtained from Charles River Laboratories (Hollister, CA) and delivered at 8-9 weeks of age. Upon arrival, mice were single-housed to prevent fighting and maintained in controlled environmental conditions with 12 hour light (6:30 AM-6:30 PM) and dark cycles (6:30 PM-6:30 AM). Mice were fed a standard rodent chow diet (2020× Harlan Teklad) with free-access to drinking water.

Figure 33A:
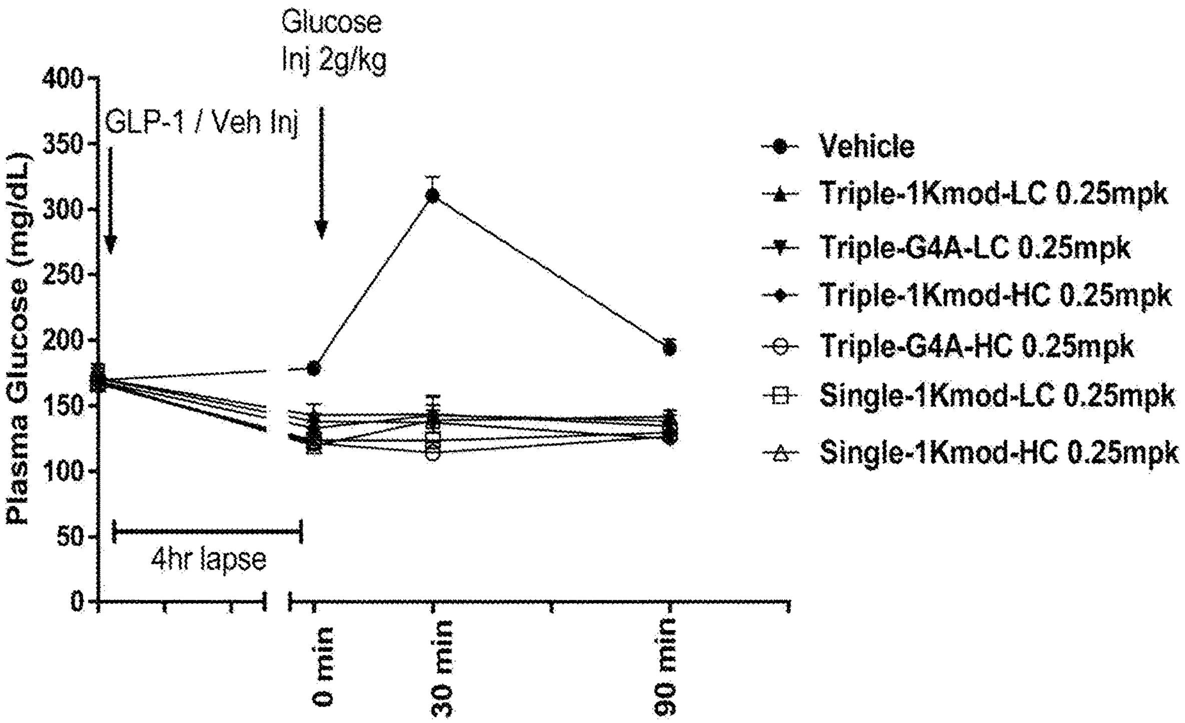
FIG. 33A-33D: Confirmation of GLP-1 activity in vivo
Figure 33B:
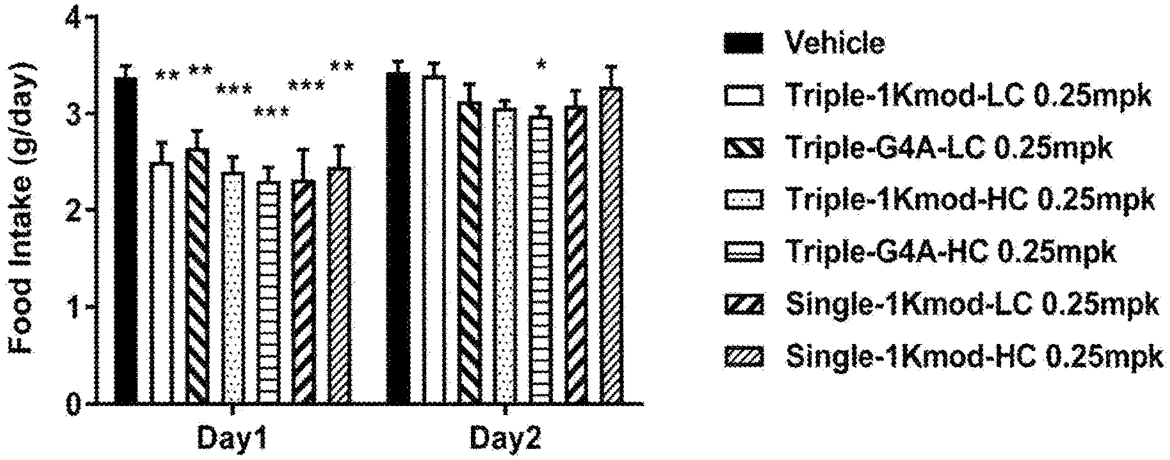
Figures 33C, 33D:
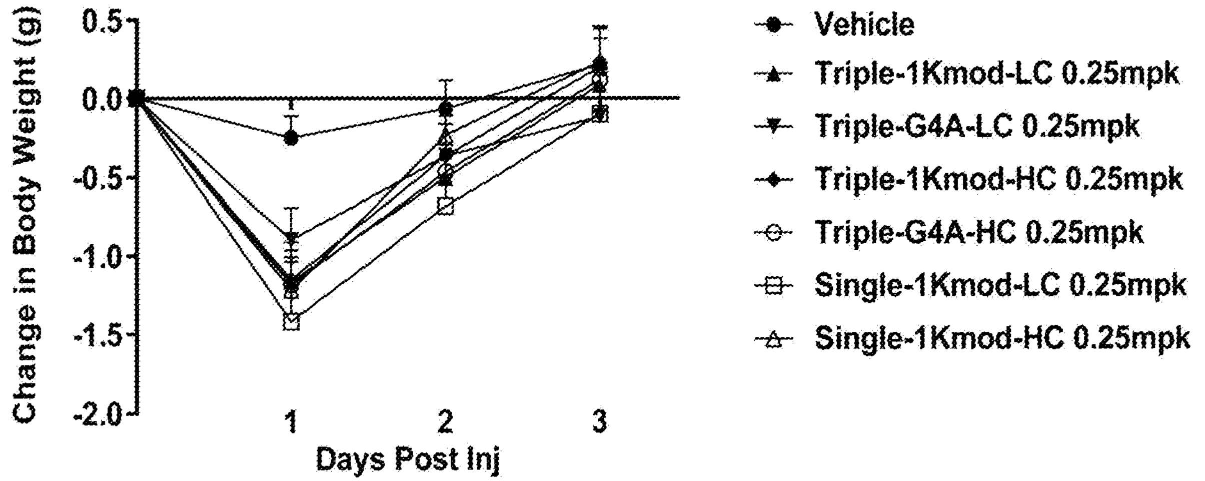
Figure 35A:
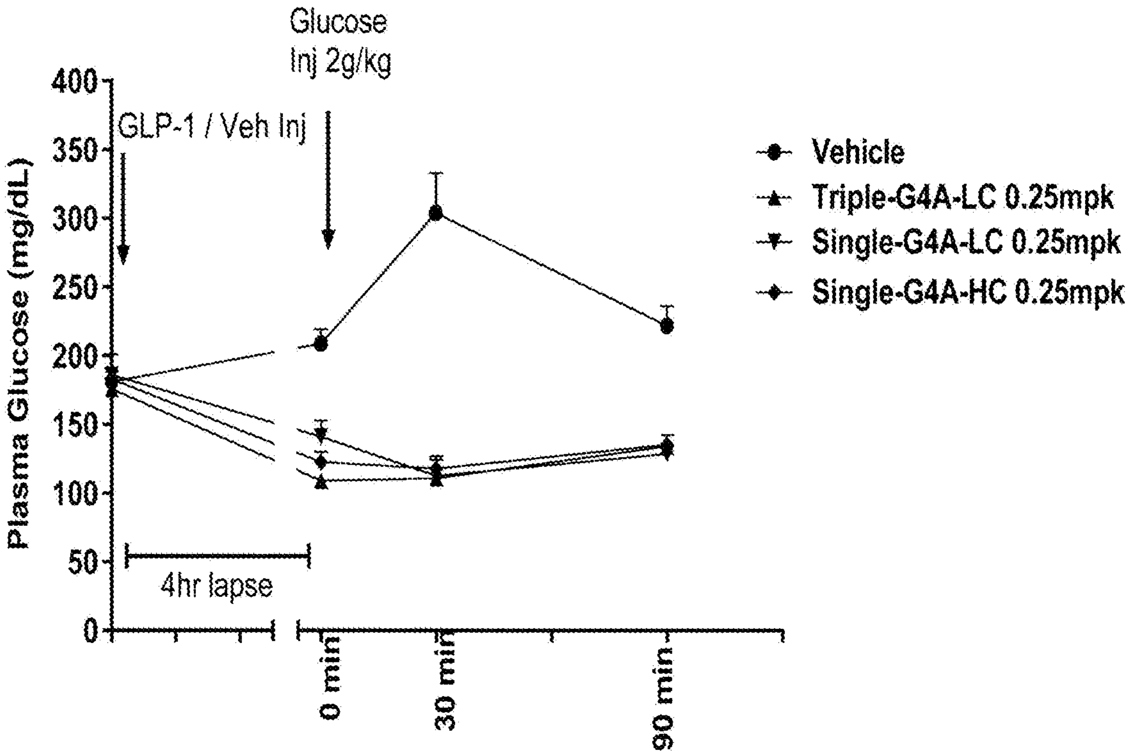
FIG. 35A-35D: Confirmation of GLP-1 activity in vivo
Figure 35B:
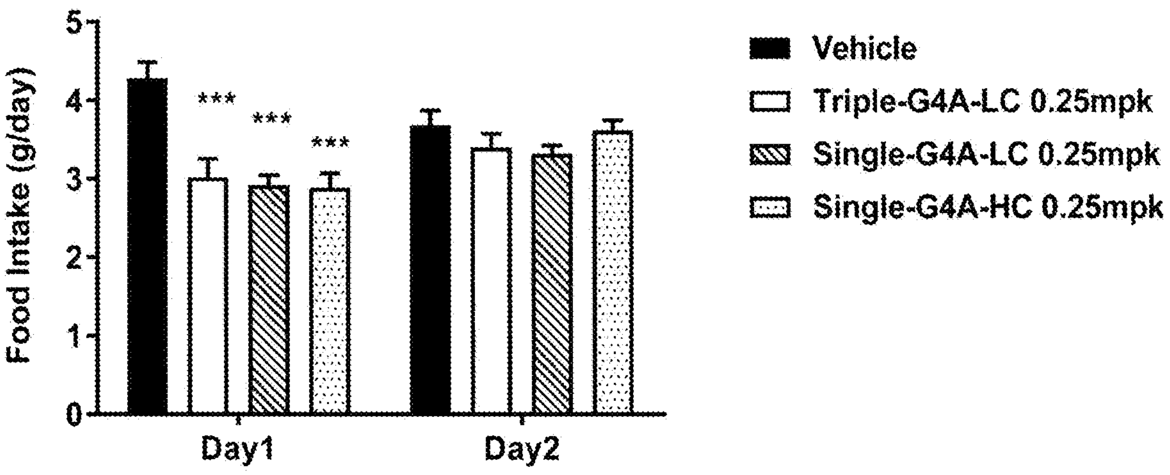
Figures 35C, 35D:
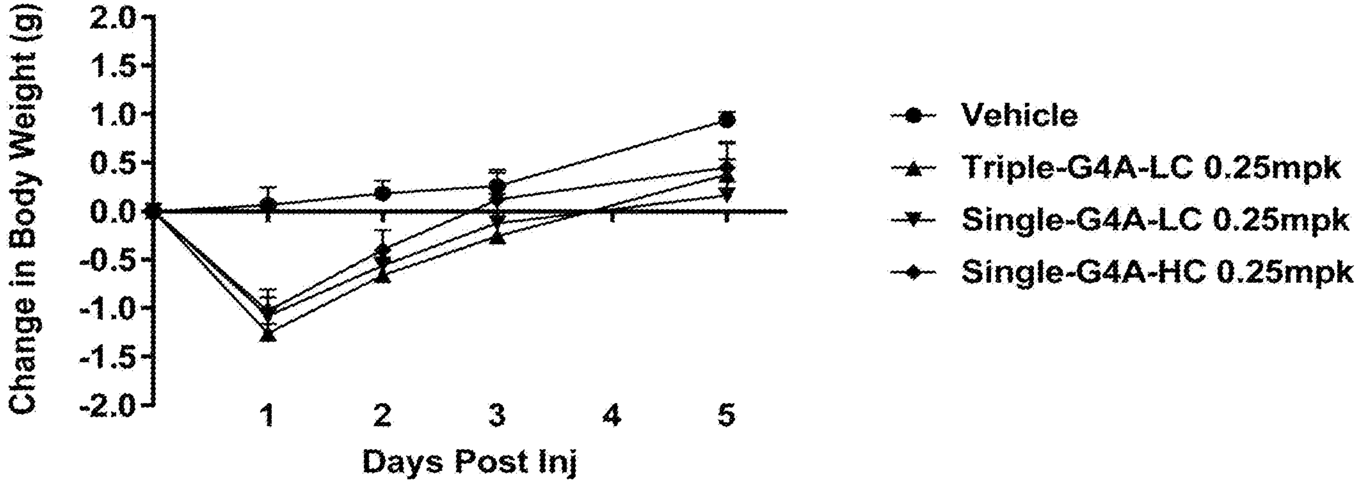

Mice were acclimated to environment conditions and handled for one week. On the day of the study, conscious mice were bled from the retro-orbital sinus for plasma glucose measurement using an AlphaTrak meter (Zoetis, Parsippany, New Jersey) and a body weight measurement was also taken. After all mice have been weighed and bled, individual plasma glucose and body weight values were used to stratify mice into treatment groups. Mice were administered by intraperitoneal (IP) injection the test article and placed into a fresh cage and fasted for four hours. Following a four hour fast, a plasma glucose measurement was taken (0 min) and immediately injected with 50% dextrose (2 g/kg, IP, Hospira) for the glucose challenge. Plasma glucose was subsequently measured at 30 and 90 minutes post glucose injection. Fresh chow was weighed and placed back into the cages after the 90 minute plasma glucose measurement. Body weight and food intake was measured approximately every 24 hours post the test article dose to observe the body weight loss and food intake inhibition effects and rebound. Results of the IPGTT on a select set of the recombinant molecules is shown in FIGS. 33 and 35.

SEQUENCE LISTING (3948 sequences)

SEQ ID NO: 1 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNGPVFGGGTKLTVLG

SEQ ID NO: 2 - protein, 108 aa, Artificial Sequence
  source: /note="Description of Artificial Sequence: Synthetic polypeptide"
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKR

SEQ ID NO: 3 - protein, 108 aa, Artificial Sequence; identical to SEQ ID NO: 2
  source: /note="Description of Artificial Sequence: Synthetic polypeptide"

SEQ ID NO: 4 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSFTISSLQPEDIATYYCQQYDILLTFGGGTKVEIKR

SEQ ID NO: 5 - protein, 114 aa, Artificial Sequence
  source: /note="Description of Artificial Sequence: Synthetic polypeptide"
DIVMTQSPDSLAVSLGERATINCKSSQSVLSSSNNKNYIAWYQQQPGHPPKLLIYWASTRESGVPDRFSGSGSGTDFTLTISSLQAEDVAVFYCQQYYSTPWTFGQGTKVEIKR

SEQ ID NO: 6 - protein, 114 aa, Artificial Sequence
  source: /note="Description of Artificial Sequence: Synthetic polypeptide"
DIVMTQSPDSLAVSLGERATINCKSSQSVLSSSNNKNYIAWYQQKPGHPPKLLIYWASTRESGVPDRFSGSGSGTDFTLTISSLQAEDVAVFYCQQYYSTPWTFGQGTKVEIKR

SEQ ID NO: 7 - protein, 114 aa, Artificial Sequence
  source: /note="Description of Artificial Sequence: Synthetic polypeptide"
DIVMTQSPDSLSVSLGERATINCKSSQSVLSSSNNKNYLAWYQQKPGQPPNLLIYWTSTRDSGVPDRFSGSGSGTDFTLTINSLQAEDVAVYYCQQYYRTPWTFGQGTKVEIKR

SEQ ID NO: 8 - protein, 114 aa, Artificial Sequence; identical to SEQ ID NO: 7
  source: /note="Description of Artificial Sequence: Synthetic polypeptide"

SEQ ID NO: 9 - protein, 109 aa, Artificial Sequence
  source: /note="Description of Artificial Sequence: Synthetic polypeptide"
EIVLTQSPGTLSLSPGERATLSCRASQSISYSYLAWYQQKPGQAPRLLIYGASSRATGIPDRFSGSGSGTDFTLTISRQEPDDFAVYYCQQYGSSPLTFGGGTKVEIKR

SEQ ID NO: 10 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKR

SEQ ID NO: 11 - protein, 108 aa, Artificial Sequence
  source: /note="Description of Artificial Sequence: Synthetic polypeptide"
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGPGTKVDVKR

SEQ ID NO: 12 - protein, 107 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTFTISSLQPEDIATYYCQQYDDLFTFGPGTKVDIKR

SEQ ID NO: 13 - protein, 108 aa, Artificial Sequence
  source: /note="Description of Artificial Sequence: Synthetic polypeptide"
DIQMTQSPSSVSASVGDRVTITCRASQGLIIWLAWYQQKPGKAPKLLIYAASSLQSGVPSRFSGSGSGTDFTLTISSLQPEDFATYYCQQTNSFPPTFGQGTKVEIKR

SEQ ID NO: 14 - protein, 108 aa, Artificial Sequence; identical to SEQ ID NO: 13
  source: /note="Description of Artificial Sequence: Synthetic polypeptide"

SEQ ID NO: 15 - protein, 108 aa, Artificial Sequence
  source: /note="Description of Artificial Sequence: Synthetic polypeptide"
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKR

SEQ ID NO: 16 - protein, 108 aa, Artificial Sequence; identical to SEQ ID NO: 15
  source: /note="Description of Artificial Sequence: Synthetic polypeptide"

SEQ ID NO: 17 - protein, 108 aa, Artificial Sequence; identical to SEQ ID NO: 15
  source: /note="Description of Artificial Sequence: Synthetic polypeptide"

SEQ ID NO: 18 - protein, 108 aa, Artificial Sequence
  source: /note="Description of Artificial Sequence: Synthetic polypeptide"
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGPGTKVDVKR

SEQ ID NO: 19 - protein, 108 aa, Artificial Sequence
  source: /note="Description of Artificial Sequence: Synthetic polypeptide"
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGQGTKVDVKR

SEQ ID NO: 20 - protein, 108 aa, Artificial Sequence; identical to SEQ ID NO: 15
  source: /note="Description of Artificial Sequence: Synthetic polypeptide"

SEQ ID NO: 21 - protein, 108 aa, Artificial Sequence
  source: /note="Description of Artificial Sequence: Synthetic polypeptide"
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGQGTKVDIKR

SEQ ID NO: 22 - protein, 108 aa, Artificial Sequence
  source: /note="Description of Artificial Sequence: Synthetic polypeptide"
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGQGTKVDIKR

SEQ ID NO: 23 - protein, 108 aa, Artificial Sequence
  source: /note="Description of Artificial Sequence: Synthetic polypeptide"
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGPGTKVDIKR

SEQ ID NO: 24 - protein, 108 aa, Artificial Sequence; identical to SEQ ID NO: 21
  source: /note="Description of Artificial Sequence: Synthetic polypeptide"

SEQ ID NO: 25 - protein, 108 aa, Artificial Sequence; identical to SEQ ID NO: 21
  source: /note="Description of Artificial Sequence: Synthetic polypeptide"

SEQ ID NO: 26 - protein, 108 aa, Artificial Sequence; identical to SEQ ID NO: 21
  source: /note="Description of Artificial Sequence: Synthetic polypeptide"

SEQ ID NO: 27 - protein, 108 aa, Artificial Sequence; identical to SEQ ID NO: 21
  source: /note="Description of Artificial Sequence: Synthetic polypeptide"

SEQ ID NO: 28 - protein, 108 aa, Artificial Sequence
  source: /note="Description of Artificial Sequence: Synthetic polypeptide"
DIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKR

SEQ ID NO: 29 - protein, 108 aa, Artificial Sequence
  source: /note="Description of Artificial Sequence: Synthetic polypeptide"
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGPGTKVDIKR

SEQ ID NO: 30 - protein, 108 aa, Artificial Sequence; identical to SEQ ID NO: 29
  source: /note="Description of Artificial Sequence: Synthetic polypeptide"

SEQ ID NO: 31 - protein, 108 aa, Artificial Sequence
  source: /note="Description of Artificial Sequence: Synthetic polypeptide"
DIQMTQSPSSLSASIGDRVTITCRASQDLRNYLGWYHQKPGKAPKLLIYGASSLQSGVPSRFSGSGSGTEFTLTISSLQPEDFATYYCLQHNNYPFTFGPGTKVDIKR

SEQ ID NO: 32 - protein, 108 aa, Artificial Sequence
  source: /note="Description of Artificial Sequence: Synthetic polypeptide"
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGPGTKVDIKR

SEQ ID NO: 33 - protein, 108 aa, Artificial Sequence; identical to SEQ ID NO: 32
  source: /note="Description of Artificial Sequence: Synthetic polypeptide"

SEQ ID NO: 34 - protein, 108 aa, Artificial Sequence; identical to SEQ ID NO: 31
  source: /note="Description of Artificial Sequence: Synthetic polypeptide"

SEQ ID NO: 35 - protein, 108 aa, Artificial Sequence; identical to SEQ ID NO: 28
  source: /note="Description of Artificial Sequence: Synthetic polypeptide"

SEQ ID NO: 36 - protein, 108 aa, Artificial Sequence; identical to SEQ ID NO: 29
  source: /note="Description of Artificial Sequence: Synthetic polypeptide"

SEQ ID NO: 37 - protein, 108 aa, Artificial Sequence; identical to SEQ ID NO: 29
  source: /note="Description of Artificial Sequence: Synthetic polypeptide"

SEQ ID NO: 38 - protein, 108 aa, Artificial Sequence
  source: /note="Description of Artificial Sequence: Synthetic polypeptide"
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGQGTKVDIKR

SEQ ID NO: 39 - protein, 108 aa, Artificial Sequence; identical to SEQ ID NO: 29
  source: /note="Description of Artificial Sequence: Synthetic polypeptide"

SEQ ID NO: 40 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSLTISSLQPEDFATYYCQQYDILLTFGGGTKVEIKR

SEQ ID NO: 41 - protein, 107 aa, Artificial Sequence; identical to SEQ ID NO: 40
  source: /note="Description of Artificial Sequence: Synthetic polypeptide"

SEQ ID NO: 42 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSLTISSLQPEDIATYYCQQYDILLTFGGGTKVEIKR

SEQ ID NO: 43 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSFTISSLQPEDFATYYCQQYDILLTFGGGTKVEIKR

SEQ ID NO: 44 - protein, 107 aa, Artificial Sequence; identical to SEQ ID NO: 42
  source: /note="Description of Artificial Sequence: Synthetic polypeptide"

SEQ ID NO: 45 - protein, 107 aa, Artificial Sequence; identical to SEQ ID NO: 43
  source: /note="Description of Artificial Sequence: Synthetic polypeptide"

SEQ ID NO: 46 - protein, 107 aa, Artificial Sequence; identical to SEQ ID NO: 4
  source: /note="Description of Artificial Sequence: Synthetic polypeptide"

SEQ ID NO: 47 - protein, 107 aa, Artificial Sequence; identical to SEQ ID NO: 40
  source: /note="Description of Artificial Sequence: Synthetic polypeptide"

SEQ ID NO: 48 - protein, 107 aa, Artificial Sequence; identical to SEQ ID NO: 40
  source: /note="Description of Artificial Sequence: Synthetic polypeptide"

SEQ ID NO: 49 - protein, 108 aa, Artificial Sequence; identical to SEQ ID NO: 2
  source: /note="Description of Artificial Sequence: Synthetic polypeptide"

SEQ ID NO: 50 - protein, 108 aa, Artificial Sequence; identical to SEQ ID NO: 2
  source: /note="Description of Artificial Sequence: Synthetic polypeptide"

SEQ ID NO: 51 - protein, 108 aa, Artificial Sequence; identical to SEQ ID NO: 21
  source: /note="Description of Artificial Sequence: Synthetic polypeptide"

SEQ ID NO: 52 - protein, 108 aa, Artificial Sequence; identical to SEQ ID NO: 21
  source: /note="Description of Artificial Sequence: Synthetic polypeptide"

SEQ ID NO: 53 - protein, 108 aa, Artificial Sequence; identical to SEQ ID NO: 23
  source: /note="Description of Artificial Sequence: Synthetic polypeptide"

SEQ ID NO: 54 - protein, 108 aa, Artificial Sequence; identical to SEQ ID NO: 23
  source: /note="Description of Artificial Sequence: Synthetic polypeptide"

SEQ ID NO: 55 - protein, 108 aa, Artificial Sequence; identical to SEQ ID NO: 23
  source: /note="Description of Artificial Sequence: Synthetic polypeptide"

SEQ ID NO: 56 - protein, 107 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGPGTKVDIKR

SEQ ID NO: 57 - protein, 107 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDIATYYCQQYDDLFTFGPGTKVDIKR

SEQ ID NO: 58 - protein, 107 aa, Artificial Sequence; identical to SEQ ID NO: 56
  source: /note="Description of Artificial Sequence: Synthetic polypeptide"

SEQ ID NO: 59 - protein, 107 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTFTISSLQPEDFATYYCQQYDDLFTFGPGTKVDIKR

SEQ ID NO: 60 - protein, 107 aa, Artificial Sequence; identical to SEQ ID NO: 57
  source: /note="Description of Artificial Sequence: Synthetic polypeptide"

SEQ ID NO: 61 - protein, 107 aa, Artificial Sequence; identical to SEQ ID NO: 59
  source: /note="Description of Artificial Sequence: Synthetic polypeptide"

SEQ ID NO: 62 - protein, 107 aa, Artificial Sequence; identical to SEQ ID NO: 12
  source: /note="Description of Artificial Sequence: Synthetic polypeptide"

SEQ ID NO: 63 - protein, 107 aa, Artificial Sequence; identical to SEQ ID NO: 56
  source: /note="Description of Artificial Sequence: Synthetic polypeptide"

SEQ ID NO: 64 - protein, 107 aa, Artificial Sequence; identical to SEQ ID NO: 56
  source: /note="Description of Artificial Sequence: Synthetic polypeptide"

SEQ ID NO: 65 - protein, 107 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGQGTKVDIKR

SEQ ID NO: 66 - protein, 107 aa, Artificial Sequence; identical to SEQ ID NO: 65
  source: /note="Description of Artificial Sequence: Synthetic polypeptide"

SEQ ID NO: 67 - protein, 108 aa, Artificial Sequence
  source: /note="Description of Artificial Sequence: Synthetic polypeptide"
EIVLTQSPGTLSLSPGERATLSCRASQIFTSTYLAWYQQKPGQAPRLLIYGASSRATGIPDRFSGSGSGTDFTLTISRLEPEDFAVYYCQQYGSSPRFGQGTRLEIKR

SEQ ID NO: 68 - protein, 108 aa, Artificial Sequence; identical to SEQ ID NO: 67
  source: /note="Description of Artificial Sequence: Synthetic polypeptide"

SEQ ID NO: 69 - protein, 108 aa, Artificial Sequence; identical to SEQ ID NO: 67
  source: /note="Description of Artificial Sequence: Synthetic polypeptide"

SEQ ID NO: 70 - protein, 108 aa, Artificial Sequence; identical to SEQ ID NO: 67
  source: /note="Description of Artificial Sequence: Synthetic polypeptide"

SEQ ID NO: 71 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKR

SEQ ID NO: 72 - protein, 108 aa, Artificial Sequence; identical to SEQ ID NO: 71
  source: /note="Description of Artificial Sequence: Synthetic polypeptide"

SEQ ID NO: 73 - protein, 108 aa, Artificial Sequence; identical to SEQ ID NO: 71
  source: /note="Description of Artificial Sequence: Synthetic polypeptide"

SEQ ID NO: 74 - protein, 108 aa, Artificial Sequence; identical to SEQ ID NO: 10
  source: /note="Description of Artificial Sequence: Synthetic polypeptide"

SEQ ID NO: 75 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNFPLTFGGGTKVEIKR

SEQ ID NO: 76 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNYPLTFGGGTKVEIKR

SEQ ID NO: 77 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNWPLTFGGGTKVEIKR

SEQ ID NO: 78 - protein, 108 aa, Artificial Sequence; identical to SEQ ID NO: 77
  source: /note="Description of Artificial Sequence: Synthetic polypeptide"

SEQ ID NO: 79 - protein, 109 aa, Artificial Sequence
  source: /note="Description of Artificial Sequence: Synthetic polypeptide"
EIVLTQSPGTLSLSPGERATLSCRASQSISYSYLAWYQQKPGQAPRLLIYGASSRATGIPDRFSGSGSGTDFTLTISRLEPDDFAVYYCQQYGSSPLTFGGGTKVEIKR

SEQ ID NO: 80 - protein, 109 aa, Artificial Sequence; identical to SEQ ID NO: 9
  source: /note="Description of Artificial Sequence: Synthetic polypeptide"

SEQ ID NO: 81 - protein, 109 aa, Artificial Sequence; identical to SEQ ID NO: 79
  source: /note="Description of Artificial Sequence: Synthetic polypeptide"

SEQ ID NO: 82 - protein, 109 aa, Artificial Sequence; identical to SEQ ID NO: 79
  source: /note="Description of Artificial Sequence: Synthetic polypeptide"

SEQ ID NO: 83 - protein, 109 aa, Artificial Sequence; identical to SEQ ID NO: 79
  source: /note="Description of Artificial Sequence: Synthetic polypeptide"

SEQ ID NO: 84 - protein, 109 aa, Artificial Sequence; identical to SEQ ID NO: 9
  source: /note="Description of Artificial Sequence: Synthetic polypeptide"

SEQ ID NO: 85 - protein, 109 aa, Artificial Sequence; identical to SEQ ID NO: 9
  source: /note="Description of Artificial Sequence: Synthetic polypeptide"

SEQ ID NO: 86 - protein, 114 aa, Artificial Sequence; identical to SEQ ID NO: 5
  source: /note="Description of Artificial Sequence: Synthetic polypeptide"

SEQ ID NO: 87 - protein, 114 aa, Artificial Sequence; identical to SEQ ID NO: 5
  source: /note="Description of Artificial Sequence: Synthetic polypeptide"

SEQ ID NO: 88 - protein, 114 aa, Artificial Sequence; identical to SEQ ID NO: 5
  source: /note="Description of Artificial Sequence: Synthetic polypeptide"

SEQ ID NO: 89 - protein, 114 aa, Artificial Sequence; identical to SEQ ID NO: 5
  source: /note="Description of Artificial Sequence: Synthetic polypeptide"

SEQ ID NO: 90 - protein, 114 aa, Artificial Sequence; identical to SEQ ID NO: 5
  source: /note="Description of Artificial Sequence: Synthetic polypeptide"

SEQ ID NO: 91 - protein, 114 aa, Artificial Sequence; identical to SEQ ID NO: 5
  source: /note="Description of Artificial Sequence: Synthetic polypeptide"

SEQ ID NO: 92 - protein, 114 aa, Artificial Sequence; identical to SEQ ID NO: 5
  source: /note="Description of Artificial Sequence: Synthetic polypeptide"

SEQ ID NO: 93 - protein, 114 aa, Artificial Sequence; identical to SEQ ID NO: 5
  source: /note="Description of Artificial Sequence: Synthetic polypeptide"

SEQ ID NO: 94 - protein, 114 aa, Artificial Sequence; identical to SEQ ID NO: 5
  source: /note="Description of Artificial Sequence: Synthetic polypeptide"

SEQ ID NO: 95 - protein, 114 aa, Artificial Sequence
  source: /note="Description of Artificial Sequence: Synthetic polypeptide"
DIVMTQSPDSLAVSLGERATINCKSSQSVLSSSNNKNYIAWYQQKPGQPPKLLIYWASTRESGVPDRFSGSGSGTDFTLTISSLQAEDVAVFYCQQYYSTPWTFGQGTKVEIKR

SEQ ID NO: 96 - protein, 114 aa, Artificial Sequence; identical to SEQ ID NO: 95
  source: /note="Description of Artificial Sequence: Synthetic polypeptide"

SEQ ID NO: 97 - protein, 114 aa, Artificial Sequence
  source: /note="Description of Artificial Sequence: Synthetic polypeptide"
DIVMTQSPDSLSVSLGERATINCKSSQSVLSSSNNKNYLAWYQQKPGQPPNLLIYWTSTRESGVPDRFSGSGSGTDFTLTINSLQAEDVAVYYCQQYYRTPWTFGQGTKVEIKR

SEQ ID NO: 98 - protein, 114 aa, Artificial Sequence; identical to SEQ ID NO: 97
  source: /note="Description of Artificial Sequence: Synthetic polypeptide"

SEQ ID NO: 99 - protein, 114 aa, Artificial Sequence; identical to SEQ ID NO: 7
  source: /note="Description of Artificial Sequence: Synthetic polypeptide"

SEQ ID NO: 100 - protein, 114 aa, Artificial Sequence; identical to SEQ ID NO: 97
  source: /note="Description of Artificial Sequence: Synthetic polypeptide"

SEQ ID NO: 101 - protein, 114 aa, Artificial Sequence; identical to SEQ ID NO: 97
  source: /note="Description of Artificial Sequence: Synthetic polypeptide"

SEQ ID NO: 102 - protein, 114 aa, Artificial Sequence; identical to SEQ ID NO: 7
  source: /note="Description of Artificial Sequence: Synthetic polypeptide"

SEQ ID NO: 103 - protein, 114 aa, Artificial Sequence; identical to SEQ ID NO: 7
  source: /note="Description of Artificial Sequence: Synthetic polypeptide"

SEQ ID NO: 104 - protein, 114 aa, Artificial Sequence
  source: /note="Description of Artificial Sequence: Synthetic polypeptide"
DIVMTQSPDSLAVSLGERATINCKSSQSVLSSSNNKNYLAWYQQKPGQPPKLLIYWTSTRESGVPDRFSGSGSGTDFTLTINSLQAEDVAVYYCQQYYRTPWTFGQGTKVEIKR

SEQ ID NO: 105 - protein, 114 aa, Artificial Sequence; identical to SEQ ID NO: 97
  source: /note="Description of Artificial Sequence: Synthetic polypeptide"

SEQ ID NO: 106 - protein, 114 aa, Artificial Sequence; identical to SEQ ID NO: 6
  source: /note="Description of Artificial Sequence: Synthetic polypeptide"

SEQ ID NO: 107 - protein, 114 aa, Artificial Sequence; identical to SEQ ID NO: 6
  source: /note="Description of Artificial Sequence: Synthetic polypeptide"

SEQ ID NO: 108 - protein, 114 aa, Artificial Sequence; identical to SEQ ID NO: 6
  source: /note="Description of Artificial Sequence: Synthetic polypeptide"

SEQ ID NO: 109 - protein, 114 aa, Artificial Sequence; identical to SEQ ID NO: 95
  source: /note="Description of Artificial Sequence: Synthetic polypeptide"

SEQ ID NO: 110 - protein, 114 aa, Artificial Sequence; identical to SEQ ID NO: 95
  source: /note="Description of Artificial Sequence: Synthetic polypeptide"

SEQ ID NO: 111 - protein, 114 aa, Artificial Sequence; identical to SEQ ID NO: 7
  source: /note="Description of Artificial Sequence: Synthetic polypeptide"

SEQ ID NO: 112 - protein, 114 aa, Artificial Sequence; identical to SEQ ID NO: 7
  source: /note="Description of Artificial Sequence: Synthetic polypeptide"

SEQ ID NO: 113 - protein, 114 aa, Artificial Sequence; identical to SEQ ID NO: 7
  source: /note="Description of Artificial Sequence: Synthetic polypeptide"

SEQ ID NO: 114 - protein, 114 aa, Artificial Sequence; identical to SEQ ID NO: 7
  source: /note="Description of Artificial Sequence: Synthetic polypeptide"

SEQ ID NO: 115 - protein, 114 aa, Artificial Sequence; identical to SEQ ID NO: 7
  source: /note="Description of Artificial Sequence: Synthetic polypeptide"

SEQ ID NO: 116 - protein, 114 aa, Artificial Sequence; identical to SEQ ID NO: 7
  source: /note="Description of Artificial Sequence: Synthetic polypeptide"

SEQ ID NO: 117 - protein, 114 aa, Artificial Sequence; identical to SEQ ID NO: 7
  source: /note="Description of Artificial Sequence: Synthetic polypeptide"

SEQ ID NO: 118 - protein, 114 aa, Artificial Sequence; identical to SEQ ID NO: 97
  source: /note="Description of Artificial Sequence: Synthetic polypeptide"

SEQ ID NO: 119 - protein, 114 aa, Artificial Sequence; identical to SEQ ID NO: 97
  source: /note="Description of Artificial Sequence: Synthetic polypeptide"

SEQ ID NO: 120 - protein, 114 aa, Artificial Sequence; identical to SEQ ID NO: 97
  source: /note="Description of Artificial Sequence: Synthetic polypeptide"

SEQ ID NO: 121 - protein, 114 aa, Artificial Sequence; identical to SEQ ID NO: 97
  source: /note="Description of Artificial Sequence: Synthetic polypeptide"

SEQ ID NO: 122 - protein, 114 aa, Artificial Sequence
  source: /note="Description of Artificial Sequence: Synthetic polypeptide"
DIVMTQSPDSLAVSLGERATINCKSSQSVLSSSNNKNYLAWYQQKPGQPPKLLIYWTSTRDSGVPDRFSGSGSGTDFTLTINSLQAEDVAVYYCQQYYRTPWTFGQGTKVEIKR

SEQ ID NO: 123 - protein, 114 aa, Artificial Sequence; identical to SEQ ID NO: 104
  source: /note="Description of Artificial Sequence: Synthetic polypeptide"

SEQ ID NO: 124 - protein, 111 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLSGPVFGGGTKLTVLG

SEQ ID NO: 125 - protein, 111 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLQGPVFGGGTKLTVLG

SEQ ID NO: 126 - protein, 111 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLSGPVFGGGTKLTVLG

SEQ ID NO: 127 - protein, 111 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLQGPVFGGGTKLTVLG

SEQ ID NO: 128 - protein, 111 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDDSLNGPVFGGGTKLTVLG

SEQ ID NO: 129 - protein, 111 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDDSLNGPVFGGGTKLTVLG

SEQ ID NO: 130 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDESLNGPVFGGGTKLTVLG

SEQ ID NO: 131 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLQGPVFGGGTKLTVLG

SEQ ID NO: 132 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLSGPVFGGGTKLTVLG

SEQ ID NO: 133 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNAPVFGGGTKLTVLG

SEQ ID NO: 134 - protein, 111 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDSSLNGPVFGGGTKLTVLG

SEQ ID NO: 135 - protein, 111 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLG

SEQ ID NO: 136 - protein, 111 aa, Artificial Sequence; identical to SEQ ID NO: 135
  source: /note="Description of Artificial Sequence: Synthetic polypeptide"

SEQ ID NO: 137 - protein, 111 aa, Artificial Sequence; identical to SEQ ID NO: 124
  source: /note="Description of Artificial Sequence: Synthetic polypeptide"

SEQ ID NO: 138 - protein, 108 aa, Artificial Sequence
  source: /note="Description of Artificial Sequence: Synthetic polypeptide"
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGQGTKVDIKR

SEQ ID NO: 139 - protein, 108 aa, Artificial Sequence; identical to SEQ ID NO: 22
  source: /note="Description of Artificial Sequence: Synthetic polypeptide"

SEQ ID NO: 140 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYTNNQRPSGVPDRFSGSKSGTSASLAISGLQSEDEADYFCATFDSSLSGPVFGGGTKLTVLG

SEQ ID NO: 141 - protein, 108 aa, Artificial Sequence
  source: /note="Description of Artificial Sequence: Synthetic polypeptide"
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITR

SEQ ID NO: 142 - protein, 111 aa, Artificial Sequence
  source: /note="Description of Artificial Sequence: Synthetic polypeptide"
QSVLTQPPSVSAAPGQKVTISCSGSSSNIGNNYVSWYEQFPGTAPKLLIYDNNKRPSGIPDRFSGSKSGTSATLGITGLQTGDEADYYCGTWDSSLSAVVFGGGTKLTVLG

SEQ ID NO: 143 - protein, 108 aa, Artificial Sequence
  source: /note="Description of Artificial Sequence: Synthetic polypeptide"
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEIKR

SEQ ID NO: 144 - protein, 108 aa, Artificial Sequence; identical to SEQ ID NO: 143
  source: /note="Description of Artificial Sequence: Synthetic polypeptide"

SEQ ID NO: 145 - protein, 108 aa, Artificial Sequence; identical to SEQ ID NO: 141
  source: /note="Description of Artificial Sequence: Synthetic polypeptide"

SEQ ID NO: 146 - protein, 108 aa, Artificial Sequence
  source: /note="Description of Artificial Sequence: Synthetic polypeptide"
DIQLTQSPSSLSASVGDRVTITCRASQTISRFLNWYQQKPGKAPKLLIYVASSLQSGVPSRFSGSGSGTDFTLTISSLQPEDFATYYCQQSYSTLISFGQGTKLEIKR

SEQ ID NO: 147 - protein, 108 aa, Artificial Sequence; identical to SEQ ID NO: 143
  source: /note="Description of Artificial Sequence: Synthetic polypeptide"

SEQ ID NO: 148 - protein, 108 aa, Artificial Sequence; identical to SEQ ID NO: 143
  source: /note="Description of Artificial Sequence: Synthetic polypeptide"

SEQ ID NO: 149 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLG

SEQ ID NO: 150 - protein, 111 aa, Artificial Sequence; identical to SEQ ID NO: 149
  source: /note="Description of Artificial Sequence: Synthetic polypeptide"

SEQ ID NO: 151 - protein, 111 aa, Artificial Sequence; identical to SEQ ID NO: 142
  source: /note="Description of Artificial Sequence: Synthetic polypeptide"

SEQ ID NO: 152 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTFESSLSAVVFGGGTKLTVLG

SEQ ID NO: 153 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSSLSAVVFGGGTKLTVLG

SEQ ID NO: 154 - protein, 111 aa, Artificial Sequence; identical to SEQ ID NO: 153
  source: /note="Description of Artificial Sequence: Synthetic polypeptide"

SEQ ID NO: 155 - protein, 111 aa, Artificial Sequence; identical to SEQ ID NO: 149
  source: /note="Description of Artificial Sequence: Synthetic polypeptide"

SEQ ID NO: 156 - protein, 111 aa, Artificial Sequence; identical to SEQ ID NO: 152
  source: /note="Description of Artificial Sequence: Synthetic polypeptide"

SEQ ID NO: 157 - protein, 108 aa, Artificial Sequence
  source: /note="Description of Artificial Sequence: Synthetic polypeptide"
DIQLTQSPSSLSASVGDRVTITCRASQTISRFLNWYQQKPGKAPKLLIYVASSLQSGVPSRFSGSGSGTDFTLTISSLQPEDFATYYCQQSYSTLLSFGQGTKLEIKR

SEQ ID NO: 158 - protein, 128 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVWGTYRPHYYYGMDVWGQGTTVTVSS

SEQ ID NO: 159 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRVADTAVYYCARDGTIFGVVLGDYWGQGTLVTVSS

SEQ ID NO: 160 - protein, 121 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSS

SEQ ID NO: 161 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISSDNSKNTLYLQMNSLRAEDTAVYYCARDRTIFGVVLDYWGQGTLVTVSS

SEQ ID NO: 162 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSS

SEQ ID NO: 163 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRFTMTRDTSISTAYMELSRLRSDDTAVYYCAREATIFGMVIVPFDYWGQGTLVTVSS

SEQ ID NO: 164 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCTREATIFGMLIVPFDYWGQGTLVTVSS

SEQ ID NO: 165 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCTREATIFGMLIVPFDYWGQGTLVTVSS

SEQ ID NO: 166 - protein, 126 aa, Artificial Sequence
  source: /note="Description of Artificial Sequence: Synthetic polypeptide"
QVQLQESGPGLVKPSQTLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 167 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDGSDKYYADSVKGRFTISRDNSKNTLYLQMNSLRAEDTAVYYCARDQAIFGVVPDYWGQGTLVTVSS

SEQ ID NO: 168 - protein, 121 aa, Artificial Sequence; identical to SEQ ID NO: 160
  source: /note="Description of Artificial Sequence: Synthetic polypeptide"

SEQ ID NO: 169 - protein, 120 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDGNNKYYADSVKGRFTISRDSSKNTLYLQMNSLRAEDTAVYYCARDRTIFGVVLEYLGQGTLVTVSS

SEQ ID NO: 170 - protein, 117 aa, Artificial Sequence
  source: /note="Description of Artificial Sequence: Synthetic polypeptide"
QVQLQESGPGLVKPSETLSLTCTVSQGSISSYYWSWIRQPAGKGLEWIGRIYTSGSTNYNPSLKSRVTMSIDTSKNQFSLKLNSVTAADTAVYYCARDVAVAGFDYWGQGTLVTVSS

SEQ ID NO: 171 - protein, 117 aa, Artificial Sequence
  source: /note="Description of Artificial Sequence: Synthetic polypeptide"
QVQLQESGPGLVKPSETLSLTCTVSGGSISSYYWSWIRQPAGKGLEWIGRIYTSGSTNYNPSLKSRVTMSIDTSKNQFSLKLNSVTAADTAVYYCARDVAVAGFDYWGQGTLVTVSS

SEQ ID NO: 172 - protein, 121 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSS

SEQ ID NO: 173 - protein, 121 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADSVKGRFTISRDNSKNTLYLQMNSLRAEDTAVYYCARDGTIFGVLLGDYWGQGTLVTVSS

SEQ ID NO: 174 - protein, 121 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADAVKGRFTISRDNSKNTLYLQMNSLRAEDTAVYYCARDGTIFGVLLGDYWGQGTLVTVSS

SEQ ID NO: 175 - protein, 121 aa, Artificial Sequence; identical to SEQ ID NO: 172
  source: /note="Description of Artificial Sequence: Synthetic polypeptide"

SEQ ID NO: 176 - protein, 121 aa, Artificial Sequence; identical to SEQ ID NO: 172
  source: /note="Description of Artificial Sequence: Synthetic polypeptide"

SEQ ID NO: 177 - protein, 121 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSS

SEQ ID NO: 178 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVADTAVYYCARDGTIFGVVLGDYWGQGTLVTVSS

SEQ ID NO: 179 - protein, 121 aa, Artificial Sequence; identical to SEQ ID NO: 178
  source: /note="Description of Artificial Sequence: Synthetic polypeptide"

SEQ ID NO: 180 - protein, 121 aa, Artificial Sequence; identical to SEQ ID NO: 178
  source: /note="Description of Artificial Sequence: Synthetic polypeptide"

SEQ ID NO: 181 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADSVKGRFTISRDNSKNTLYLHMNSLRVADTAVYYCARDGTIFGVVLGDYWGQGTLVTVSS

SEQ ID NO: 182 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADAVKGRFTISRDNSKNTLYLHMNSLRVADTAVYYCARDGTIFGVVLGDYWGQGTLVTVSS

SEQ ID NO: 183 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDRTIFGVVLGDYWGQGTLVTVSS

SEQ ID NO: 184 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDGTIFGVVLGDYWGQGTLVTVSS

SEQ ID NO: 185 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSS

SEQ ID NO: 186 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAADTAVYYCARDGTIFGVVLGDYWGQGTLVTVSS

SEQ ID NO: 187 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLHMNSLRAADTAVYYCARDGTIFGVVLGDYWGQGTLVTVSS

SEQ ID NO: 188 - protein, 121 aa, Artificial Sequence; identical to SEQ ID NO: 186
  source: /note="Description of Artificial Sequence: Synthetic polypeptide"

SEQ ID NO: 189 - protein, 121 aa, Artificial Sequence; identical to SEQ ID NO: 186
  source: /note="Description of Artificial Sequence: Synthetic polypeptide"

SEQ ID NO: 190 - protein, 121 aa, Artificial Sequence; identical to SEQ ID NO: 187
  source: /note="Description of Artificial Sequence: Synthetic polypeptide"

SEQ ID NO: 191 - protein, 121 aa, Artificial Sequence; identical to SEQ ID NO: 187
  source: /note="Description of Artificial Sequence: Synthetic polypeptide"

SEQ ID NO: 192 - protein, 121 aa, Artificial Sequence; identical to SEQ ID NO: 186
  source: /note="Description of Artificial Sequence: Synthetic polypeptide"

SEQ ID NO: 193 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADAVKGRFTISRDNSKNTLYLQMNSLRAADTAVYYCARDGTIFGVVLGDYWGQGTLVTVSS

SEQ ID NO: 194 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADSVKGRFTISRDNSKNTLYLQMNSLRAADTAVYYCARDGTIFGVVLGDYWGQGTLVTVSS

SEQ ID NO: 195 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDRTIFGVVLGDYWGQGTLVTVSS

SEQ ID NO: 196 - protein, 121 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDGTIFGVVLGDYWGQGTLVTVSS

SEQ ID NO: 197 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADAVKGRFTISRDNSKNTLYLQMNSLRAEDTAVYYCARDRTIFGVVLDYWGQGTLVTVSS

SEQ ID NO: 198 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADAVKGRFTISSDNSKNTLYLQMNSLRAEDTAVYYCARDRTIFGVVLDYWGQGTLVTVSS

SEQ ID NO: 199 - protein, 120 aa, Artificial Sequence; identical to SEQ ID NO: 197
  source: /note="Description of Artificial Sequence: Synthetic polypeptide"

SEQ ID NO: 200 - protein, 120 aa, Artificial Sequence; identical to SEQ ID NO: 197
  source: /note="Description of Artificial Sequence: Synthetic polypeptide"

SEQ ID NO: 201 - protein, 120 aa, Artificial Sequence; identical to SEQ ID NO: 198
  source: /note="Description of Artificial Sequence: Synthetic polypeptide"

SEQ ID NO: 202 - protein, 120 aa, Artificial Sequence; identical to SEQ ID NO: 198
  source: /note="Description of Artificial Sequence: Synthetic polypeptide"

SEQ ID NO: 203 - protein, 120 aa, Artificial Sequence; identical to SEQ ID NO: 197
  source: /note="Description of Artificial Sequence: Synthetic polypeptide"

SEQ ID NO: 204 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADSVKGRFTISRDNSKNTLYLQMNSLRAEDTAVYYCARDRTIFGVVLDYWGQGTLVTVSS

SEQ ID NO: 205 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADAVKGRFTISRDNSKNTLYLQMNSLRAEDTAVYYCARDRTIFGVVLDYWGQGTLVTVSS

SEQ ID NO: 206 - protein, 121 aa, Artificial Sequence; identical to SEQ ID NO: 172
  source: /note="Description of Artificial Sequence: Synthetic polypeptide"

SEQ ID NO: 207 - protein, 121 aa, Artificial Sequence; identical to SEQ ID NO: 177
  source: /note="Description of Artificial Sequence: Synthetic polypeptide"

SEQ ID NO: 208 - protein, 121 aa, Artificial Sequence; identical to SEQ ID NO: 172
  source: /note="Description of Artificial Sequence: Synthetic polypeptide"

SEQ ID NO: 209 - protein, 121 aa, Artificial Sequence; identical to SEQ ID NO: 177
  source: /note="Description of Artificial Sequence: Synthetic polypeptide"

SEQ ID NO: 210 - protein, 121 aa, Artificial Sequence; identical to SEQ ID NO: 160
  source: /note="Description of Artificial Sequence: Synthetic polypeptide"

SEQ ID NO: 211 - protein, 121 aa, Artificial Sequence; identical to SEQ ID NO: 173
  source: /note="Description of Artificial Sequence: Synthetic polypeptide"

SEQ ID NO: 212 - protein, 121 aa, Artificial Sequence; identical to SEQ ID NO: 174
  source: /note="Description of Artificial Sequence: Synthetic polypeptide"

SEQ ID NO: 213 - protein, 120 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYWGQGTLVTVSS

SEQ ID NO: 214 - protein, 120 aa, Artificial Sequence; identical to SEQ ID NO: 213
  source: /note="Description of Artificial Sequence: Synthetic polypeptide"

SEQ ID NO: 215 - protein, 120 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYLGQGTLVTVSS

SEQ ID NO: 216 - protein, 120 aa, Artificial Sequence; identical to SEQ ID NO: 213
  source: /note="Description of Artificial Sequence: Synthetic polypeptide"

SEQ ID NO: 217 - protein, 120 aa, Artificial Sequence; identical to SEQ ID NO: 215
  source: /note="Description of Artificial Sequence: Synthetic polypeptide"

SEQ ID NO: 218 - protein, 120 aa, Artificial Sequence; identical to SEQ ID NO: 215
  source: /note="Description of Artificial Sequence: Synthetic polypeptide"

SEQ ID NO: 219 - protein, 120 aa, Artificial Sequence; identical to SEQ ID NO: 213
  source: /note="Description of Artificial Sequence: Synthetic polypeptide"

SEQ ID NO: 220 - protein, 120 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDGNNKYYADAVKGRFTISRDSSKNTLYLQMNSLRAEDTAVYYCARDRTIFGVVLEYWGQGTLVTVSS

SEQ ID NO: 221 - protein, 120 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADSVKGRFTISRDSSKNTLYLQMNSLRAEDTAVYYCARDRTIFGVVLEYWGQGTLVTVSS

SEQ ID NO: 222 - protein, 120 aa, Artificial Sequence; identical to SEQ ID NO: 213
  source: /note="Description of Artificial Sequence: Synthetic polypeptide"

SEQ ID NO: 223 - protein, 120 aa, Artificial Sequence; identical to SEQ ID NO: 215
  source: /note="Description of Artificial Sequence: Synthetic polypeptide"

SEQ ID NO: 224 - protein, 120 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDASNKYYEDAVKGRFTISRDNSKNTLFLQVNSLRAEDTAVYYCARGITIFGHGFEYWGQGTLVTVSS

SEQ ID NO: 225 - protein, 120 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDGSNKYYEDSVKGRFTISRDNSKNTLFLQVNSLRAEDTAVYYCARGITIFGHGFEYWGQGTLVTVSS

SEQ ID NO: 226 - protein, 120 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDGSNKYYEDAVKGRFTISRDNSKNTLFLQVNSLRAEDTAVYYCARGITIFGHGFEYWGQGTLVTVSS

SEQ ID NO: 227 - protein, 120 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDASNKYYEDSVKGRFTISRDNSKNTLFLQVNSLRAEDTAVYYCARGITIFGHGFEYWGQGTLVTVSS

SEQ ID NO: 228 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSS

SEQ ID NO: 229 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADSVKGRFTISRDNSKNTLYLQMNSLRAEDTAVYYCARDQAIFGVVPDYWGQGTLVTVSS

SEQ ID NO: 230 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDGSDKYYADAVKGRFTISRDNSKNTLYLQMNSLRAEDTAVYYCARDQAIFGVVPDYWGQGTLVTVSS

SEQ ID NO: 231 - protein, 120 aa, Artificial Sequence; identical to SEQ ID NO: 228
  source: /note="Description of Artificial Sequence: Synthetic polypeptide"

SEQ ID NO: 232 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSS

SEQ ID NO: 233 - protein, 120 aa, Artificial Sequence; identical to SEQ ID NO: 232
  source: /note="Description of Artificial Sequence: Synthetic polypeptide"

SEQ ID NO: 234 - protein, 120 aa, Artificial Sequence; identical to SEQ ID NO: 228
  source: /note="Description of Artificial Sequence: Synthetic polypeptide"

SEQ ID NO: 235 - protein, 120 aa, Artificial Sequence; identical to SEQ ID NO: 232
  source: /note="Description of Artificial Sequence: Synthetic polypeptide"

SEQ ID NO: 236 - protein, 126 aa, Artificial Sequence
  source: /note="Description of Artificial Sequence: Synthetic polypeptide"
QVQLQESGPGLVKPSETLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 237 - protein, 126 aa, Artificial Sequence; identical to SEQ ID NO: 236
  source: /note="Description of Artificial Sequence: Synthetic polypeptide"

SEQ ID NO: 238 - protein, 126 aa, Artificial Sequence
  source: /note="Description of Artificial Sequence: Synthetic polypeptide"
QVQLQESGPGLVKPSQTLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 239 - protein, 126 aa, Artificial Sequence
  source: /note="Description of Artificial Sequence: Synthetic polypeptide"
QVQLQESGPGLVKPSETLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSS

SEQ ID NO: 240 - protein, 126 aa, Artificial Sequence; identical to SEQ ID NO: 166
  source: /note="Description of Artificial Sequence: Synthetic polypeptide"

SEQ ID NO: 241 - protein, 126 aa, Artificial Sequence; identical to SEQ ID NO: 239
  source: /note="Description of Artificial Sequence: Synthetic polypeptide"

SEQ ID NO: 242 - protein, 126 aa, Artificial Sequence; identical to SEQ ID NO: 238
  source: /note="Description of Artificial Sequence: Synthetic polypeptide"

SEQ ID NO: 243 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELNRLRSDDTAVYYCAREATIFGMVIVPFDYWGQGTLVTVSS

SEQ ID NO: 244 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRFTMTRDTSISTAYMELNRLRSDDTAVYYCAREATIFGMVIVPFDYWGQGTLVTVSS

SEQ ID NO: 245 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSS

SEQ ID NO: 246 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSS

SEQ ID NO: 247 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSS

SEQ ID NO: 248 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSS

SEQ ID NO: 249 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSS

SEQ ID NO: 250 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSS

SEQ ID NO: 251 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSS

SEQ ID NO: 252 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRVTMTRDTSISTAYMELNSLRSDDTAVYYCAREATIFGMVIVPFDYWGQGTLVTVSS

SEQ ID NO: 253 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELNSLRSDDTAVYYCAREATIFGMVIVPFDYWGQGTLVTVSS

SEQ ID NO: 254 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCAREATIFGMLIVPFDYWGQGTLVTVSS

SEQ ID NO: 255 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCAREATIFGMLIVPFDYWGQGTLVTVSS

SEQ ID NO: 256 - protein, 123 aa, Artificial Sequence; identical to SEQ ID NO: 254
  source: /note="Description of Artificial Sequence: Synthetic polypeptide"

SEQ ID NO: 257 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCTREATIFGMLIVPFDYWGQGTLVTVSS

SEQ ID NO: 258 - protein, 123 aa, Artificial Sequence; identical to SEQ ID NO: 164
  source: /note="Description of Artificial Sequence: Synthetic polypeptide"

SEQ ID NO: 259 - protein, 123 aa, Artificial Sequence; identical to SEQ ID NO: 257
  source: /note="Description of Artificial Sequence: Synthetic polypeptide"

SEQ ID NO: 260 - protein, 123 aa, Artificial Sequence; identical to SEQ ID NO: 255
  source: /note="Description of Artificial Sequence: Synthetic polypeptide"

SEQ ID NO: 261 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNSGETSYAQKFQDRVTMTRDTSISTAYMELSSLRSDDTAVYFCAREATIFGMLIVPFDYWGQGTLVTVSS

SEQ ID NO: 262 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNSGETSYAQKFQDRVTMTRDTSISTAYMELSRLRSDDTAVYFCAREATIFGMLIVPFDYWGQGTLVTVSS

SEQ ID NO: 263 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRVTMTRDTSISTAYMELSRLRSDDTAVYYCAREATIFGMVIVPFDYWGQGTLVTVSS

SEQ ID NO: 264 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRFTMTRDTSISTAYMELSRLRSDDTAVYYCAREATIFGMVIVPFDYWGQGTLVTVSS

SEQ ID NO: 265 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRVTMTRDTSISTAYMELSRLRSDDTAVYYCAREATIFGMVIVPFDYWGQGTLVTVSS

SEQ ID NO: 266 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELSSLRSDDTAVYYCAREATIFGMVIVPFDYWGQGTLVTVSS

SEQ ID NO: 267 - protein, 123 aa, Artificial Sequence; identical to SEQ ID NO: 263
  source: /note="Description of Artificial Sequence: Synthetic polypeptide"

SEQ ID NO: 268 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCAREATIFGMLIVPFDYWGQGTLVTVSS

SEQ ID NO: 269 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCAREATIFGMLIVPFDYWGQGTLVTVSS

SEQ ID NO: 270 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCTREATIFGMLIVPFDYWGQGTLVTVSS

SEQ ID NO: 271 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCAREATIFGMLIVPFDYWGQGTLVTVSS

SEQ ID NO: 272 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCAREATIFGMLIVPFDYWGQGTLVTVSS

SEQ ID NO: 273 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCTREATIFGMLIVPFDYWGQGTLVTVSS

SEQ ID NO: 274 - protein, 123 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCTREATIFGMLIVPFDYWGQGTLVTVSS

SEQ ID NO: 275 - protein, 123 aa, Artificial Sequence; identical to SEQ ID NO: 268
  source: /note="Description of Artificial Sequence: Synthetic polypeptide"

SEQ ID NO: 276 - protein, 123 aa, Artificial Sequence; identical to SEQ ID NO: 272
  source: /note="Description of Artificial Sequence: Synthetic polypeptide"

SEQ ID NO: 277 - protein, 123 aa, Artificial Sequence; identical to SEQ ID NO: 269
  source: /note="Description of Artificial Sequence: Synthetic polypeptide"

SEQ ID NO: 278 - protein, 123 aa, Artificial Sequence; identical to SEQ ID NO: 271
  source: /note="Description of Artificial Sequence: Synthetic polypeptide"

SEQ ID NO: 279 - protein, 123 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNQGETNYAQKFQDRVTMTRDTSISTAYMELSSLRSDDTAVYYCAREATIFGMLIVPFDYWGQGTLVTVSS

SEQ ID NO: 280 - protein, 123 aa, Artificial Sequence; identical to SEQ ID NO: 279
  source: /note="Description of Artificial Sequence: Synthetic polypeptide"

SEQ ID NO: 281 - protein, 128 aa, Artificial Sequence; identical to SEQ ID NO: 158
  source: /note="Description of Artificial Sequence: Synthetic polypeptide"

SEQ ID NO: 282 - protein, 128 aa, Artificial Sequence; identical to SEQ ID NO: 158
  source: /note="Description of Artificial Sequence: Synthetic polypeptide"

SEQ ID NO: 283 - protein, 128 aa, Artificial Sequence; identical to SEQ ID NO: 158
  source: /note="Description of Artificial Sequence: Synthetic polypeptide"

SEQ ID NO: 284 - protein, 128 aa, Artificial Sequence; identical to SEQ ID NO: 158
  source: /note="Description of Artificial Sequence: Synthetic polypeptide"

SEQ ID NO: 285 - protein, 128 aa, Artificial Sequence; identical to SEQ ID NO: 158
  source: /note="Description of Artificial Sequence: Synthetic polypeptide"

SEQ ID NO: 286 - protein, 128 aa, Artificial Sequence; identical to SEQ ID NO: 158
  source: /note="Description of Artificial Sequence: Synthetic polypeptide"

SEQ ID NO: 287 - protein, 128 aa, Artificial Sequence; identical to SEQ ID NO: 158
  source: /note="Description of Artificial Sequence: Synthetic polypeptide"

SEQ ID NO: 288 - protein, 128 aa, Artificial Sequence; identical to SEQ ID NO: 158
  source: /note="Description of Artificial Sequence: Synthetic polypeptide"

SEQ ID NO: 289 - protein, 128 aa, Artificial Sequence; identical to SEQ ID NO: 158
  source: /note="Description of Artificial Sequence: Synthetic polypeptide"

SEQ ID NO: 290 - protein, 128 aa, Artificial Sequence; identical to SEQ ID NO: 158
  source: /note="Description of Artificial Sequence: Synthetic polypeptide"

SEQ ID NO: 291 - protein, 128 aa, Artificial Sequence; identical to SEQ ID NO: 158
  source: /note="Description of Artificial Sequence: Synthetic polypeptide"

SEQ ID NO: 292 - protein, 128 aa, Artificial Sequence; identical to SEQ ID NO: 158
  source: /note="Description of Artificial Sequence: Synthetic polypeptide"

SEQ ID NO: 293 - protein, 128 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSS

SEQ ID NO: 294 - protein, 128 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVFGTYRPHYYYGMDVWGQGTTVTVSS

SEQ ID NO: 295 - protein, 121 aa, Artificial Sequence; identical to SEQ ID NO: 195
  source: /note="Description of Artificial Sequence: Synthetic polypeptide"

SEQ ID NO: 296 - protein, 121 aa, Artificial Sequence; identical to SEQ ID NO: 177
  source: /note="Description of Artificial Sequence: Synthetic polypeptide"

SEQ ID NO: 297 - protein, 128 aa, Artificial Sequence; identical to SEQ ID NO: 158
  source: /note="Description of Artificial Sequence: Synthetic polypeptide"

SEQ ID NO: 298 - protein, 121 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSS

SEQ ID NO: 299 - protein, 129 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGNTGYAQKFQGRVTMTRDTSISTAYMELSSLRSQDTAVYYCARGGDYVWGSYRPYYYYYGMDVWGQGTTVTVSS

SEQ ID NO: 300 - protein, 121 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSS

SEQ ID NO: 301 - protein, 121 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSS

SEQ ID NO: 302 - protein, 121 aa, Artificial Sequence; identical to SEQ ID NO: 300
  source: /note="Description of Artificial Sequence: Synthetic polypeptide"

SEQ ID NO: 303 - protein, 121 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTLVTVSS

SEQ ID NO: 304 - protein, 121 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADSVKGRFTISRDNSKNTLYLQMNSLRAEDSAMYFCARGKVAGMPEAFEIWGQGTKVTVSS

SEQ ID NO: 305 - protein, 121 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDGSNKFHADAVKGRFTISRDNSKNTLYLQMNSLRAEDSAMYFCARGKVAGMPEAFEIWGQGTKVTVSS

SEQ ID NO: 306 - protein, 129 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVWGSYRPYYYYYGMDVWGQGTTVTVSS

SEQ ID NO: 307 - protein, 129 aa, Artificial Sequence; identical to SEQ ID NO: 299
  source: /note="Description of Artificial Sequence: Synthetic polypeptide"

SEQ ID NO: 308 - protein, 129 aa, Artificial Sequence; identical to SEQ ID NO: 306
  source: /note="Description of Artificial Sequence: Synthetic polypeptide"

SEQ ID NO: 309 - protein, 129 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVWGSYRPYYYYYGMDVWGQGTTVTVSS

SEQ ID NO: 310 - protein, 129 aa, Artificial Sequence; identical to SEQ ID NO: 306
  source: /note="Description of Artificial Sequence: Synthetic polypeptide"

SEQ ID NO: 311 - protein, 129 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGNTGYAQKFQGRVTMTRDTSISTAYMELSSLRSDDTAVYYCARGGDYVWGSYRPYYYYYGMDVWGQGTTVTVSS

SEQ ID NO: 312 - protein, 129 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVFGSYRPYYYYYGMDVWGQGTTVTVSS

SEQ ID NO: 313 - protein, 129 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVFGSYRPYYYYYGMDVWGQGTTVTVSS

SEQ ID NO: 314 - protein, 121 aa, Artificial Sequence; identical to SEQ ID NO: 303
  source: /note="Description of Artificial Sequence: Synthetic polypeptide"

SEQ ID NO: 315 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 316 - protein, 214 aa, Artificial Sequence
  source: /note="Description of Artificial Sequence: Synthetic polypeptide"
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 214 aa, Artificial Sequence; identical to SEQ ID NO: 316
  source: /note="Description of Artificial Sequence: Synthetic polypeptide"

SEQ ID NO: 318 - protein, 213 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSFTISSLQPEDIATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - protein, 220 aa, Artificial Sequence
  source: /note="Description of Artificial Sequence: Synthetic polypeptide"
DIVMTQSPDSLAVSLGERATINCKSSQSVLSSSNNKNYIAWYQQQPGHPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - protein, 220 aa, Artificial Sequence
  source: /note="Description of Artificial Sequence: Synthetic polypeptide"
DIVMTQSPDSLAVSLGERATINCKSSQSVLSSSNNKNYIAWYQQKPGHPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 220 aa, Artificial Sequence
  source: /note="Description of Artificial Sequence: Synthetic polypeptide"
DIVMTQSPDSLSVSLGERATINCKSSQSVLSSSNNKNYLAWYQQKPGQPPNLLIYWTSTRDSGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 220 aa, Artificial Sequence; identical to SEQ ID NO: 321
  source: /note="Description of Artificial Sequence: Synthetic polypeptide"

SEQ ID NO: 323 - protein, 215 aa, Artificial Sequence
  source: /note="Description of Artificial Sequence: Synthetic polypeptide"
EIVLTQSPGTLSLSPGERATLSCRASQSISYSYLAWYQQKPGQAPRLLIYGASSRATGIPDRFSGSGSGTDFTLTISRQEPDDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 325 - protein, 214 aa, Artificial Sequence
  source: /note="Description of Artificial Sequence: Synthetic polypeptide"
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 213 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTFTISSLQPEDIATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 214 aa, Artificial Sequence
  source: /note="Description of Artificial Sequence: Synthetic polypeptide"
DIQMTQSPSSVSASVGDRVTITCRASQGLIIWLAWYQQKPGKAPKLLIYAASSLQSGVPSRFSGSGSGTDFTLTISSLQPEDFATYYCQQTNSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 214 aa, Artificial Sequence; identical to SEQ ID NO: 327
  source: /note="Description of Artificial Sequence: Synthetic polypeptide"

SEQ ID NO: 329 - protein, 214 aa, Artificial Sequence
  source: /note="Description of Artificial Sequence: Synthetic polypeptide"
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGQGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 214 aa, Artificial Sequence; identical to SEQ ID NO: 329
  source: /note="Description of Artificial Sequence: Synthetic polypeptide"

SEQ ID NO: 331 - protein, 214 aa, Artificial Sequence; identical to SEQ ID NO: 329
  source: /note="Description of Artificial Sequence: Synthetic polypeptide"

SEQ ID NO: 332 - protein, 214 aa, Artificial Sequence
  source: /note="Description of Artificial Sequence: Synthetic polypeptide"
DIQMTQSPSSLSASVGDRVTITCRASQGIRNELGWYQQKPGKAPKLLIYGASSLQSGVPSRFSGSGSGTEFTLTISSLQPEDFVTYYCLQHNSYPFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 214 aa, Artificial Sequence
  source: /note="Description of Artificial Sequence: Synthetic polypeptide"
DIQMTQSPSSLSASVGDRVTITCRASQGIRNELGWYQQKPGKAPKRLIYGASSLQSGVPSRFSGSGSGTEFTLTISSLQPEDFVTYYCLQHNSYPFTFGQGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 214 aa, Artificial Sequence; identical to SEQ ID NO: 329
  source: /note="Description of Artificial Sequence: Synthetic polypeptide"

SEQ ID NO: 335 - protein, 214 aa, Artificial Sequence
  source: /note="Description of Artificial Sequence: Synthetic polypeptide"
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 214 aa, Artificial Sequence
  source: /note="Description of Artificial Sequence: Synthetic polypeptide"
DIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 214 aa, Artificial Sequence
  source: /note="Description of Artificial Sequence: Synthetic polypeptide"
DIQMTQSPSSLSASIGDRVTITCRASQDIRDYLGWYQQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 214 aa, Artificial Sequence; identical to SEQ ID NO: 335
  source: /note="Description of Artificial Sequence: Synthetic polypeptide"

SEQ ID NO: 339 - protein, 214 aa, Artificial Sequence; identical to SEQ ID NO: 335
  source: /note="Description of Artificial Sequence: Synthetic polypeptide"

SEQ ID NO: 340 - protein, 214 aa, Artificial Sequence; identical to SEQ ID NO: 335
  source: /note="Description of Artificial Sequence: Synthetic polypeptide"

SEQ ID NO: 341 - protein, 214 aa, Artificial Sequence; identical to SEQ ID NO: 335
  source: /note="Description of Artificial Sequence: Synthetic polypeptide"

SEQ ID NO: 342 - protein, 214 aa, Artificial Sequence
  source: /note="Description of Artificial Sequence: Synthetic polypeptide"
DIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 343 - protein, 214 aa, Artificial Sequence
  source: /note="Description of Artificial Sequence: Synthetic polypeptide"
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - protein, 214 aa, Artificial Sequence; identical to SEQ ID NO: 343
  source: /note="Description of Artificial Sequence: Synthetic polypeptide"

SEQ ID NO: 345 - protein, 214 aa, Artificial Sequence
  source: /note="Description of Artificial Sequence: Synthetic polypeptide"
DIQMTQSPSSLSASIGDRVTITCRASQDLRNYLGWYHQKPGKAPKLLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - protein, 214 aa, Artificial Sequence
  source: /note="Description of Artificial Sequence: Synthetic polypeptide"
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 214 aa, Artificial Sequence; identical to SEQ ID NO: 346
  source: /note="Description of Artificial Sequence: Synthetic polypeptide"

SEQ ID NO: 348 - protein, 214 aa, Artificial Sequence; identical to SEQ ID NO: 345
  source: /note="Description of Artificial Sequence: Synthetic polypeptide"

SEQ ID NO: 349 - protein, 214 aa, Artificial Sequence; identical to SEQ ID NO: 342
  source: /note="Description of Artificial Sequence: Synthetic polypeptide"

SEQ ID NO: 350 - protein, 214 aa, Artificial Sequence; identical to SEQ ID NO: 343
  source: /note="Description of Artificial Sequence: Synthetic polypeptide"

SEQ ID NO: 351 - protein, 214 aa, Artificial Sequence; identical to SEQ ID NO: 343
  source: /note="Description of Artificial Sequence: Synthetic polypeptide"

SEQ ID NO: 352 - protein, 214 aa, Artificial Sequence
  source: /note="Description of Artificial Sequence: Synthetic polypeptide"
DIQMTQSPSSLSASIGDRVTITCRASQDLRNYLGWYQQKPGKAPKLLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 353 - protein, 214 aa, Artificial Sequence; identical to SEQ ID NO: 343
  source: /note="Description of Artificial Sequence: Synthetic polypeptide"

SEQ ID NO: 354 - protein, 213 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSLTISSLQPEDFATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 355 - protein, 213 aa, Artificial Sequence; identical to SEQ ID NO: 354
  source: /note="Description of Artificial Sequence: Synthetic polypeptide"

SEQ ID NO: 356 - protein, 213 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSLTISSLQPEDIATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 357 - protein, 213 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFSFTISSLQPEDFATYYCQQYDILLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 358 - protein, 213 aa, Artificial Sequence; identical to SEQ ID NO: 356
  source: /note="Description of Artificial Sequence: Synthetic polypeptide"

SEQ ID NO: 359 - protein, 213 aa, Artificial Sequence; identical to SEQ ID NO: 357
  source: /note="Description of Artificial Sequence: Synthetic polypeptide"

SEQ ID NO: 360 - protein, 213 aa, Artificial Sequence; identical to SEQ ID NO: 318
  source: /note="Description of Artificial Sequence: Synthetic polypeptide"

SEQ ID NO: 361 - protein, 213 aa, Artificial Sequence; identical to SEQ ID NO: 354
  source: /note="Description of Artificial Sequence: Synthetic polypeptide"

SEQ ID NO: 362 - protein, 213 aa, Artificial Sequence; identical to SEQ ID NO: 354
  source: /note="Description of Artificial Sequence: Synthetic polypeptide"

SEQ ID NO: 363 - protein, 214 aa, Artificial Sequence; identical to SEQ ID NO: 316
  source: /note="Description of Artificial Sequence: Synthetic polypeptide"

SEQ ID NO: 364 - protein, 214 aa, Artificial Sequence; identical to SEQ ID NO: 316
  source: /note="Description of Artificial Sequence: Synthetic polypeptide"

SEQ ID NO: 365 - protein, 214 aa, Artificial Sequence; identical to SEQ ID NO: 335
  source: /note="Description of Artificial Sequence: Synthetic polypeptide"

SEQ ID NO: 366 - protein, 214 aa, Artificial Sequence; identical to SEQ ID NO: 335
  source: /note="Description of Artificial Sequence: Synthetic polypeptide"

SEQ ID NO: 367 - protein, 214 aa, Artificial Sequence; identical to SEQ ID NO: 337
  source: /note="Description of Artificial Sequence: Synthetic polypeptide"

SEQ ID NO: 368 - protein, 214 aa, Artificial Sequence; identical to SEQ ID NO: 337
  source: /note="Description of Artificial Sequence: Synthetic polypeptide"

SEQ ID NO: 369 - protein, 214 aa, Artificial Sequence; identical to SEQ ID NO: 337
  source: /note="Description of Artificial Sequence: Synthetic polypeptide"

SEQ ID NO: 370 - protein, 213 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 213 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDIATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 372 - protein, 213 aa, Artificial Sequence; identical to SEQ ID NO: 370
  source: /note="Description of Artificial Sequence: Synthetic polypeptide"

SEQ ID NO: 373 - protein, 213 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTFTISSLQPEDFATYYCQQYDDLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 374 - protein, 213 aa, Artificial Sequence; identical to SEQ ID NO: 371
  source: /note="Description of Artificial Sequence: Synthetic polypeptide"

SEQ ID NO: 375 - protein, 213 aa, Artificial Sequence; identical to SEQ ID NO: 373
  source: /note="Description of Artificial Sequence: Synthetic polypeptide"

SEQ ID NO: 376 - protein, 213 aa, Artificial Sequence; identical to SEQ ID NO: 326
  source: /note="Description of Artificial Sequence: Synthetic polypeptide"

SEQ ID NO: 377 - protein, 213 aa, Artificial Sequence; identical to SEQ ID NO: 370
  source: /note="Description of Artificial Sequence: Synthetic polypeptide"

SEQ ID NO: 378 - protein, 213 aa, Artificial Sequence; identical to SEQ ID NO: 370
  source: /note="Description of Artificial Sequence: Synthetic polypeptide"

SEQ ID NO: 379 - protein, 213 aa, Artificial Sequence
  source: /note="Description of Artificial Sequence: Synthetic polypeptide"
DIQMTQSPSSLSASVGDRVTITCQASQDITNYLNWYQQKPGKAPKLLIYDASNLEPGVPSRFSGSGSGTDFTLTISSLQPEDFATYYCQQYDDLFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - protein, 213 aa, Artificial Sequence; identical to SEQ ID NO: 379
  source: /note="Description of Artificial Sequence: Synthetic polypeptide"

SEQ ID NO: 381 - protein, 214 aa, Artificial Sequence
  source: /note="Description of Artificial Sequence: Synthetic polypeptide"
EIVLTQSPGTLSLSPGERATLSCRASQIFTSTYLAWYQQKPGQAPRLLIYGASSRATGIPDRFSGSGSGTDFTLTISRLEPEDFAVYYCQQYGSSPRFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 214 aa, Artificial Sequence; identical to SEQ ID NO: 381
  source: /note="Description of Artificial Sequence: Synthetic polypeptide"

SEQ ID NO: 383 - protein, 214 aa, Artificial Sequence; identical to SEQ ID NO: 381
  source: /note="Description of Artificial Sequence: Synthetic polypeptide"

SEQ ID NO: 384 - protein, 214 aa, Artificial Sequence; identical to SEQ ID NO: 381
  source: /note="Description of Artificial Sequence: Synthetic polypeptide"

SEQ ID NO: 385 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 214 aa, Artificial Sequence; identical to SEQ ID NO: 385
  source: /note="Description of Artificial Sequence: Synthetic polypeptide"

SEQ ID NO: 387 - protein, 214 aa, Artificial Sequence; identical to SEQ ID NO: 385
  source: /note="Description of Artificial Sequence: Synthetic polypeptide"

SEQ ID NO: 388 - protein, 214 aa, Artificial Sequence; identical to SEQ ID NO: 324
  source: /note="Description of Artificial Sequence: Synthetic polypeptide"

SEQ ID NO: 389 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARFSGSGSGTEFTLTISSLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 392 - protein, 214 aa, Artificial Sequence; identical to SEQ ID NO: 391
  source: /note="Description of Artificial Sequence: Synthetic polypeptide"

SEQ ID NO: 393 - protein, 215 aa, Artificial Sequence
  source: /note="Description of Artificial Sequence: Synthetic polypeptide"
EIVLTQSPGTLSLSPGERATLSCRASQSISYSYLAWYQQKPGQAPRLLIYGASSRATGIPDRFSGSGSGTDFTLTISRLEPDDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 215 aa, Artificial Sequence; identical to SEQ ID NO: 323
  source: /note="Description of Artificial Sequence: Synthetic polypeptide"

SEQ ID NO: 395 - protein, 215 aa, Artificial Sequence; identical to SEQ ID NO: 393
  source: /note="Description of Artificial Sequence: Synthetic polypeptide"

SEQ ID NO: 396 - protein, 215 aa, Artificial Sequence; identical to SEQ ID NO: 393
  source: /note="Description of Artificial Sequence: Synthetic polypeptide"

SEQ ID NO: 397 - protein, 215 aa, Artificial Sequence; identical to SEQ ID NO: 393
  source: /note="Description of Artificial Sequence: Synthetic polypeptide"

SEQ ID NO: 398 - protein, 215 aa, Artificial Sequence; identical to SEQ ID NO: 323
  source: /note="Description of Artificial Sequence: Synthetic polypeptide"

SEQ ID NO: 399 - protein, 215 aa, Artificial Sequence; identical to SEQ ID NO: 323
  source: /note="Description of Artificial Sequence: Synthetic polypeptide"

SEQ ID NO: 400 - protein, 220 aa, Artificial Sequence; identical to SEQ ID NO: 319
  source: /note="Description of Artificial Sequence: Synthetic polypeptide"

SEQ ID NO: 401 - protein, 220 aa, Artificial Sequence; identical to SEQ ID NO: 319
  source: /note="Description of Artificial Sequence: Synthetic polypeptide"

SEQ ID NO: 402 - protein, 220 aa, Artificial Sequence; identical to SEQ ID NO: 319
  source: /note="Description of Artificial Sequence: Synthetic polypeptide"

SEQ ID NO: 403 - protein, 220 aa, Artificial Sequence; identical to SEQ ID NO: 319
  source: /note="Description of Artificial Sequence: Synthetic polypeptide"

SEQ ID NO: 404 - protein, 220 aa, Artificial Sequence; identical to SEQ ID NO: 319
  source: /note="Description of Artificial Sequence: Synthetic polypeptide"

SEQ ID NO: 405 - protein, 220 aa, Artificial Sequence; identical to SEQ ID NO: 319
  source: /note="Description of Artificial Sequence: Synthetic polypeptide"

SEQ ID NO: 406 - protein, 220 aa, Artificial Sequence; identical to SEQ ID NO: 319
  source: /note="Description of Artificial Sequence: Synthetic polypeptide"

SEQ ID NO: 407 - protein, 220 aa, Artificial Sequence; identical to SEQ ID NO: 319
  source: /note="Description of Artificial Sequence: Synthetic polypeptide"

SEQ ID NO: 408 - protein, 220 aa, Artificial Sequence; identical to SEQ ID NO: 319
  source: /note="Description of Artificial Sequence: Synthetic polypeptide"

SEQ ID NO: 409 - protein, 220 aa, Artificial Sequence
  source: /note="Description of Artificial Sequence: Synthetic polypeptide"
DIVMTQSPDSLAVSLGERATINCKSSQSVLSSSNNKNYIAWYQQKPGQPPKLLIYWASTRESGVPDRFSGSGSGTDFTLTISSLQAEDVAVFYCQQYYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 410 - protein, 220 aa, Artificial Sequence; identical to SEQ ID NO: 409
  source: /note="Description of Artificial Sequence: Synthetic polypeptide"

SEQ ID NO: 411 - protein, 220 aa, Artificial Sequence
  source: /note="Description of Artificial Sequence: Synthetic polypeptide"
DIVMTQSPDSLSVSLGERATINCKSSQSVLSSSNNKNYLAWYQQKPGQPPNLLIYWTSTRESGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 220 aa, Artificial Sequence; identical to SEQ ID NO: 411
  source: /note="Description of Artificial Sequence: Synthetic polypeptide"

SEQ ID NO: 413 - protein, 220 aa, Artificial Sequence; identical to SEQ ID NO: 321
  source: /note="Description of Artificial Sequence: Synthetic polypeptide"

SEQ ID NO: 414 - protein, 220 aa, Artificial Sequence; identical to SEQ ID NO: 411
  source: /note="Description of Artificial Sequence: Synthetic polypeptide"

SEQ ID NO: 415 - protein, 220 aa, Artificial Sequence; identical to SEQ ID NO: 411
  source: /note="Description of Artificial Sequence: Synthetic polypeptide"

SEQ ID NO: 416 - protein, 220 aa, Artificial Sequence; identical to SEQ ID NO: 321
  source: /note="Description of Artificial Sequence: Synthetic polypeptide"

SEQ ID NO: 417 - protein, 220 aa, Artificial Sequence; identical to SEQ ID NO: 321
  source: /note="Description of Artificial Sequence: Synthetic polypeptide"

SEQ ID NO: 418 - protein, 220 aa, Artificial Sequence
  source: /note="Description of Artificial Sequence: Synthetic polypeptide"
DIVMTQSPDSLAVSLGERATINCKSSQSVLSSSNNKNYLAWYQQKPGQPPKLLIYWTSTRESGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 220 aa, Artificial Sequence; identical to SEQ ID NO: 411
  source: /note="Description of Artificial Sequence: Synthetic polypeptide"

SEQ ID NO: 420 - protein, 220 aa, Artificial Sequence; identical to SEQ ID NO: 320
  source: /note="Description of Artificial Sequence: Synthetic polypeptide"

SEQ ID NO: 421 - protein, 220 aa, Artificial Sequence; identical to SEQ ID NO: 320
  source: /note="Description of Artificial Sequence: Synthetic polypeptide"

SEQ ID NO: 422 - protein, 220 aa, Artificial Sequence; identical to SEQ ID NO: 320
  source: /note="Description of Artificial Sequence: Synthetic polypeptide"

SEQ ID NO: 423 - protein, 220 aa, Artificial Sequence; identical to SEQ ID NO: 409
  source: /note="Description of Artificial Sequence: Synthetic polypeptide"

SEQ ID NO: 424 - protein, 220 aa, Artificial Sequence; identical to SEQ ID NO: 409
  source: /note="Description of Artificial Sequence: Synthetic polypeptide"

SEQ ID NO: 425 - protein, 220 aa, Artificial Sequence; identical to SEQ ID NO: 321
  source: /note="Description of Artificial Sequence: Synthetic polypeptide"

SEQ ID NO: 426 - protein, 220 aa, Artificial Sequence; identical to SEQ ID NO: 321
  source: /note="Description of Artificial Sequence: Synthetic polypeptide"

SEQ ID NO: 427 - protein, 220 aa, Artificial Sequence; identical to SEQ ID NO: 321
  source: /note="Description of Artificial Sequence: Synthetic polypeptide"

SEQ ID NO: 428 - protein, 220 aa, Artificial Sequence; identical to SEQ ID NO: 321
  source: /note="Description of Artificial Sequence: Synthetic polypeptide"

SEQ ID NO: 429 - protein, 220 aa, Artificial Sequence; identical to SEQ ID NO: 321
  source: /note="Description of Artificial Sequence: Synthetic polypeptide"

SEQ ID NO: 430 - protein, 220 aa, Artificial Sequence; identical to SEQ ID NO: 321
  source: /note="Description of Artificial Sequence: Synthetic polypeptide"

SEQ ID NO: 431 - protein, 220 aa, Artificial Sequence; identical to SEQ ID NO: 321
  source: /note="Description of Artificial Sequence: Synthetic polypeptide"

SEQ ID NO: 432 - protein, 220 aa, Artificial Sequence; identical to SEQ ID NO: 411
  source: /note="Description of Artificial Sequence: Synthetic polypeptide"

SEQ ID NO: 433 - protein, 220 aa, Artificial Sequence; identical to SEQ ID NO: 411
  source: /note="Description of Artificial Sequence: Synthetic polypeptide"

SEQ ID NO: 434 - protein, 220 aa, Artificial Sequence; identical to SEQ ID NO: 411
  source: /note="Description of Artificial Sequence: Synthetic polypeptide"

SEQ ID NO: 435 - protein, 220 aa, Artificial Sequence; identical to SEQ ID NO: 411
  source: /note="Description of Artificial Sequence: Synthetic polypeptide"

SEQ ID NO: 436 - protein, 220 aa, Artificial Sequence
  source: /note="Description of Artificial Sequence: Synthetic polypeptide"
DIVMTQSPDSLAVSLGERATINCKSSQSVLSSSNNKNYLAWYQQKPGQPPKLLIYWTSTRDSGVPDRFSGSGSGTDFTLTINSLQAEDVAVYYCQQYYRTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 437 - protein, 220 aa, Artificial Sequence; identical to SEQ ID NO: 418
  source: /note="Description of Artificial Sequence: Synthetic polypeptide"

SEQ ID NO: 438 - protein, 216 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 439 - protein, 216 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDESLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 440 - protein, 216 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 441 - protein, 216 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDESLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 442 - protein, 216 aa, Artificial Sequence
  source: /note="Description of Artificial Sequence: Synthetic polypeptide"
QSVLTQPPSASGTPGQRVTISCSGSSSNIGSQTVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 443 - protein, 216 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 444 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDESLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 445 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLQGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 446 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 447 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDDSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 448 - protein, 216 aa, Artificial Sequence
  source: /note="Description of Artificial Sequence: Synthetic polypeptide"
QSVLTQPPSASGTPGQRVTISCSGSSSNIGSNTVNWYQHLPGTAPKLLIYTNNQRPSGVPDRFSGSKSGTSASLAISGLQSEDEADYFCATFDSSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 449 - protein, 216 aa, Artificial Sequence
  source: /note="Description of Artificial Sequence: Synthetic polypeptide"
QSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 450 - protein, 216 aa, Artificial Sequence; identical to SEQ ID NO: 449
  source: /note="Description of Artificial Sequence: Synthetic polypeptide"

SEQ ID NO: 451 - protein, 216 aa, Artificial Sequence; identical to SEQ ID NO: 438
  source: /note="Description of Artificial Sequence: Synthetic polypeptide"

SEQ ID NO: 452 - protein, 214 aa, Artificial Sequence
  source: /note="Description of Artificial Sequence: Synthetic polypeptide"
DIQMTQSPSSLSASIGDRVTITCRASQDLRNYLGWYQQKPGKAPKRLIYGASSLQSGVPSRFSGSGSGTEFTLTISSLQPEDFATYYCLQHNNYPFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 453 - protein, 214 aa, Artificial Sequence; identical to SEQ ID NO: 336
  source: /note="Description of Artificial Sequence: Synthetic polypeptide"

SEQ ID NO: 454 - protein, 216 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYTNNQRPSGVPDRFSGSKSGTSASLAISGLQSEDEADYFCATFDSSLSGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 455 - protein, 214 aa, Artificial Sequence
  source: /note="Description of Artificial Sequence: Synthetic polypeptide"
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 216 aa, Artificial Sequence
  source: /note="Description of Artificial Sequence: Synthetic polypeptide"
QSVLTQPPSVSAAPGQKVTISCSGSSSNIGNNYVSWYEQFPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 457 - protein, 214 aa, Artificial Sequence
  source: /note="Description of Artificial Sequence: Synthetic polypeptide"
DIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 214 aa, Artificial Sequence; identical to SEQ ID NO: 457
  source: /note="Description of Artificial Sequence: Synthetic polypeptide"

SEQ ID NO: 459 - protein, 214 aa, Artificial Sequence; identical to SEQ ID NO: 455
  source: /note="Description of Artificial Sequence: Synthetic polypeptide"

SEQ ID NO: 460 - protein, 214 aa, Artificial Sequence
  source: /note="Description of Artificial Sequence: Synthetic polypeptide"
DIQLTQSPSSLSASVGDRVTITCRASQTISRFLNWYQQKPGKAPKLLIYVASSLQSGVPSRFSGSGSGTDFTLTISSLQPEDFATYYCQQSYSTLISFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 214 aa, Artificial Sequence; identical to SEQ ID NO: 457
  source: /note="Description of Artificial Sequence: Synthetic polypeptide"

SEQ ID NO: 462 - protein, 214 aa, Artificial Sequence; identical to SEQ ID NO: 457
  source: /note="Description of Artificial Sequence: Synthetic polypeptide"

SEQ ID NO: 463 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 464 - protein, 216 aa, Artificial Sequence; identical to SEQ ID NO: 463
  source: /note="Description of Artificial Sequence: Synthetic polypeptide"

SEQ ID NO: 465 - protein, 216 aa, Artificial Sequence; identical to SEQ ID NO: 456
  source: /note="Description of Artificial Sequence: Synthetic polypeptide"

SEQ ID NO: 466 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTFESSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 467 - protein, 216 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLAITGLQTGDEADYYCGTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 468 - protein, 216 aa, Artificial Sequence; identical to SEQ ID NO: 467
  source: /note="Description of Artificial Sequence: Synthetic polypeptide"

SEQ ID NO: 469 - protein, 216 aa, Artificial Sequence; identical to SEQ ID NO: 463
  source: /note="Description of Artificial Sequence: Synthetic polypeptide"

SEQ ID NO: 470 - protein, 216 aa, Artificial Sequence; identical to SEQ ID NO: 466
  source: /note="Description of Artificial Sequence: Synthetic polypeptide"

SEQ ID NO: 471 - protein, 214 aa, Artificial Sequence
  source: /note="Description of Artificial Sequence: Synthetic polypeptide"
DIQLTQSPSSLSASVGDRVTITCRASQTISRFLNWYQQKPGKAPKLLIYVASSLQSGVPSRFSGSGSGTDFTLTISSLQPEDFATYYCQQSYSTLLSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - protein, 458 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVWGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 450 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISSDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRFTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 480 - protein, 456 aa, Artificial Sequence
  source: /note="Description of Artificial Sequence: Synthetic polypeptide"
QVQLQESGPGLVKPSQTLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDGSDKYYADSVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 451 aa, Artificial Sequence; identical to SEQ ID NO: 474
  source: /note="Description of Artificial Sequence: Synthetic polypeptide"

SEQ ID NO: 483 - protein, 450 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDGNNKYYADSVKGRFTISRDSSKNTLYLQMNSLRAEDTAVYYCARDRTIFGVVLEYLGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 447 aa, Artificial Sequence
  source: /note="Description of Artificial Sequence: Synthetic polypeptide"
QVQLQESGPGLVKPSETLSLTCTVSQGSISSYYWSWIRQPAGKGLEWIGRIYTSGSTNYNPSLKSRVTMSIDTSKNQFSLKLNSVTAADTAVYYCARDVAVAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 447 aa, Artificial Sequence
  source: /note="Description of Artificial Sequence: Synthetic polypeptide"
QVQLQESGPGLVKPSETLSLTCTVSGGSISSYYWSWIRQPAGKGLEWIGRIYTSGSTNYNPSLKSRVTMSIDTSKNQFSLKLNSVTAADTAVYYCARDVAVAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADAVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 451 aa, Artificial Sequence; identical to SEQ ID NO: 486
  source: /note="Description of Artificial Sequence: Synthetic polypeptide"

SEQ ID NO: 490 - protein, 451 aa, Artificial Sequence; identical to SEQ ID NO: 486
  source: /note="Description of Artificial Sequence: Synthetic polypeptide"

SEQ ID NO: 491 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDASNKYYADAVKGRFTISRDNSKNTLYLQMNSLRAEDTAVYYCARDRTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 451 aa, Artificial Sequence; identical to SEQ ID NO: 492
  source: /note="Description of Artificial Sequence: Synthetic polypeptide"

SEQ ID NO: 494 - protein, 451 aa, Artificial Sequence; identical to SEQ ID NO: 492
  source: /note="Description of Artificial Sequence: Synthetic polypeptide"

SEQ ID NO: 495 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADSVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 496 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADAVKGRFTISRDNSKNTLYLHMNSLRVADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDRTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 498 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRVEDTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 502 - protein, 451 aa, Artificial Sequence; identical to SEQ ID NO: 500
  source: /note="Description of Artificial Sequence: Synthetic polypeptide"

SEQ ID NO: 503 - protein, 451 aa, Artificial Sequence; identical to SEQ ID NO: 500
  source: /note="Description of Artificial Sequence: Synthetic polypeptide"

SEQ ID NO: 504 - protein, 451 aa, Artificial Sequence; identical to SEQ ID NO: 501
  source: /note="Description of Artificial Sequence: Synthetic polypeptide"

SEQ ID NO: 505 - protein, 451 aa, Artificial Sequence; identical to SEQ ID NO: 501
  source: /note="Description of Artificial Sequence: Synthetic polypeptide"

SEQ ID NO: 506 - protein, 451 aa, Artificial Sequence; identical to SEQ ID NO: 500
  source: /note="Description of Artificial Sequence: Synthetic polypeptide"

SEQ ID NO: 507 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADAVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADSVKGRFTISRDNSKNTLYLQMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDRTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDASNENYADAVKGRFTISRDNSKNTLYLQMNSLRAEDTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 450 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADAVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 512 - protein, 450 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADAVKGRFTISSDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 450 aa, Artificial Sequence; identical to SEQ ID NO: 511
  source: /note="Description of Artificial Sequence: Synthetic polypeptide"

SEQ ID NO: 514 - protein, 450 aa, Artificial Sequence; identical to SEQ ID NO: 511
  source: /note="Description of Artificial Sequence: Synthetic polypeptide"

SEQ ID NO: 515 - protein, 450 aa, Artificial Sequence; identical to SEQ ID NO: 512
  source: /note="Description of Artificial Sequence: Synthetic polypeptide"

SEQ ID NO: 516 - protein, 450 aa, Artificial Sequence; identical to SEQ ID NO: 512
  source: /note="Description of Artificial Sequence: Synthetic polypeptide"

SEQ ID NO: 517 - protein, 450 aa, Artificial Sequence; identical to SEQ ID NO: 511
  source: /note="Description of Artificial Sequence: Synthetic polypeptide"

SEQ ID NO: 518 - protein, 450 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDASNKYYADSVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 450 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADAVKGRFTISRDNSKNTLYLQMNSLRAEDTAVYYCARDRTIFGVVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 451 aa, Artificial Sequence; identical to SEQ ID NO: 486
  source: /note="Description of Artificial Sequence: Synthetic polypeptide"

SEQ ID NO: 521 - protein, 451 aa, Artificial Sequence; identical to SEQ ID NO: 491
  source: /note="Description of Artificial Sequence: Synthetic polypeptide"

SEQ ID NO: 522 - protein, 451 aa, Artificial Sequence; identical to SEQ ID NO: 486
  source: /note="Description of Artificial Sequence: Synthetic polypeptide"

SEQ ID NO: 523 - protein, 451 aa, Artificial Sequence; identical to SEQ ID NO: 491
  source: /note="Description of Artificial Sequence: Synthetic polypeptide"

SEQ ID NO: 524 - protein, 451 aa, Artificial Sequence; identical to SEQ ID NO: 474
  source: /note="Description of Artificial Sequence: Synthetic polypeptide"

SEQ ID NO: 525 - protein, 451 aa, Artificial Sequence; identical to SEQ ID NO: 487
  source: /note="Description of Artificial Sequence: Synthetic polypeptide"

SEQ ID NO: 526 - protein, 451 aa, Artificial Sequence; identical to SEQ ID NO: 488
  source: /note="Description of Artificial Sequence: Synthetic polypeptide"

SEQ ID NO: 527 - protein, 450 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 450 aa, Artificial Sequence; identical to SEQ ID NO: 527
  source: /note="Description of Artificial Sequence: Synthetic polypeptide"

SEQ ID NO: 529 - protein, 450 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADAVKGRFTISRDSSKNTLYLQMNSLRAEDTAVYYCARDRTIFGVVLEYLGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 450 aa, Artificial Sequence; identical to SEQ ID NO: 527
  source: /note="Description of Artificial Sequence: Synthetic polypeptide"

SEQ ID NO: 531 - protein, 450 aa, Artificial Sequence; identical to SEQ ID NO: 529
  source: /note="Description of Artificial Sequence: Synthetic polypeptide"

SEQ ID NO: 532 - protein, 450 aa, Artificial Sequence; identical to SEQ ID NO: 529
  source: /note="Description of Artificial Sequence: Synthetic polypeptide"

SEQ ID NO: 533 - protein, 450 aa, Artificial Sequence; identical to SEQ ID NO: 527
  source: /note="Description of Artificial Sequence: Synthetic polypeptide"

SEQ ID NO: 534 - protein, 450 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDGNNKYYADAVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 535 - protein, 450 aa, Artificial Sequence
  source: /note="Description of Artificial Sequence: Synthetic polypeptide"
QVQLVESGGGVVQPGRSLRLSCAASGFSFSSYGMHWVRQPPGKGLEWVAAIWYDANNKYYADSVKGRFTISRDSSKNTLYLQMNSLRAEDTAVYYCARDRTIFGVVLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - protein, 450 aa, Artificial Sequence; identical to SEQ ID NO: 527
  source: /note="Description of Artificial Sequence: Synthetic polypeptide"

SEQ ID NO: 537 - protein, 450 aa, Artificial Sequence; identical to SEQ ID NO: 529
  source: /note="Description of Artificial Sequence: Synthetic polypeptide"

SEQ ID NO: 538 - protein, 450 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDASNKYYEDAVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 539 - protein, 450 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDGSNKYYEDSVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 450 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDGSNKYYEDAVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - protein, 450 aa, Artificial Sequence
  source: /note="Description of Artificial Sequence: Synthetic polypeptide"
QVQLVESGGGVVQPGRSLRLSCAASGFSFSSYGMHWVRQAPGKGLEWVAVIWYDASNKYYEDSVKGRFTISRDNSKNTLFLQVNSLRAEDTAVYYCARGITIFGHGFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADSVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 544 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDGSDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 545 - protein, 450 aa, Artificial Sequence; identical to SEQ ID NO: 542
  source: /note="Description of Artificial Sequence: Synthetic polypeptide"

SEQ ID NO: 546 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 450 aa, Artificial Sequence; identical to SEQ ID NO: 546
  source: /note="Description of Artificial Sequence: Synthetic polypeptide"

SEQ ID NO: 548 - protein, 450 aa, Artificial Sequence; identical to SEQ ID NO: 542
  source: /note="Description of Artificial Sequence: Synthetic polypeptide"

SEQ ID NO: 549 - protein, 450 aa, Artificial Sequence; identical to SEQ ID NO: 546
  source: /note="Description of Artificial Sequence: Synthetic polypeptide"

SEQ ID NO: 550 - protein, 456 aa, Artificial Sequence
  source: /note="Description of Artificial Sequence: Synthetic polypeptide"
QVQLQESGPGLVKPSETLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 551 - protein, 456 aa, Artificial Sequence; identical to SEQ ID NO: 550
  source: /note="Description of Artificial Sequence: Synthetic polypeptide"

SEQ ID NO: 552 - protein, 456 aa, Artificial Sequence
  source: /note="Description of Artificial Sequence: Synthetic polypeptide"
QVQLQESGPGLVKPSQTLSLTCTVSGDSISSGGYYWSWIRQPPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 553 - protein, 456 aa, Artificial Sequence
  source: /note="Description of Artificial Sequence: Synthetic polypeptide"
QVQLQESGPGLVKPSETLSLTCTVSGDSISSGGYYWSWIRQHPGKGLEWIGYIYYSGSTYYNPSLKSRVTISVDTSKNQFSLKLSSVTAADTAVYYCARDRITIFGVVMGGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 554 - protein, 456 aa, Artificial Sequence; identical to SEQ ID NO: 480
  source: /note="Description of Artificial Sequence: Synthetic polypeptide"

SEQ ID NO: 555 - protein, 456 aa, Artificial Sequence; identical to SEQ ID NO: 553
  source: /note="Description of Artificial Sequence: Synthetic polypeptide"

SEQ ID NO: 556 - protein, 456 aa, Artificial Sequence; identical to SEQ ID NO: 552
  source: /note="Description of Artificial Sequence: Synthetic polypeptide"

SEQ ID NO: 557 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 558 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 559 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 561 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDSGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRFTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDAGGTDYSQRFQGRVTMTRDTSISTAYMELNRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 566 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPDAGGTDYSQRFQGRVTMTRDTSISTAYMELNSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 567 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELNSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 568 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 569 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGDTSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 570 - protein, 453 aa, Artificial Sequence; identical to SEQ ID NO: 568
  source: /note="Description of Artificial Sequence: Synthetic polypeptide"

SEQ ID NO: 571 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLVWMGWISPNSGETSYAQKFQDRVTMTRDTSISTAYMELSRLRSDDTAVYFCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 572 - protein, 453 aa, Artificial Sequence; identical to SEQ ID NO: 478
  source: /note="Description of Artificial Sequence: Synthetic polypeptide"

SEQ ID NO: 573 - protein, 453 aa, Artificial Sequence; identical to SEQ ID NO: 571
  source: /note="Description of Artificial Sequence: Synthetic polypeptide"

SEQ ID NO: 574 - protein, 453 aa, Artificial Sequence; identical to SEQ ID NO: 569
  source: /note="Description of Artificial Sequence: Synthetic polypeptide"

SEQ ID NO: 575 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNSGETSYAQKFQDRVTMTRDTSISTAYMELSSLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 576 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNSGETSYAQKFQDRVTMTRDTSISTAYMELSRLRSDDTAVYFCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRVTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPESGGTDYSQRFQGRFTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWINPDSGGTDYSQRFQGRVTMTRDTSISTAYMELSRLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 580 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPESGGTDYSQRFQGRVTMTRDTSISTAYMELSSLRSDDTAVYYCAREATIFGMVIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 453 aa, Artificial Sequence; identical to SEQ ID NO: 577
  source: /note="Description of Artificial Sequence: Synthetic polypeptide"

SEQ ID NO: 582 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 583 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGETNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 585 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 586 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGDTNYAQKFQDRVTMTRDTSISTAYMELSRLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNQGDTNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 588 - protein, 453 aa, Artificial Sequence
  source: /note="Description of Artificial Sequence: Synthetic polypeptide"
QVPLVQSGAEVKKPGASVKVSCKASGYTFTGYYIHWVRQAPGQGLEWMGWISPNNGETNYAQKFQDRVTMTRDTSISTAYMELSRLRSDDTAVYYCTREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - protein, 453 aa, Artificial Sequence; identical to SEQ ID NO: 582
  source: /note="Description of Artificial Sequence: Synthetic polypeptide"

SEQ ID NO: 590 - protein, 453 aa, Artificial Sequence; identical to SEQ ID NO: 586
  source: /note="Description of Artificial Sequence: Synthetic polypeptide"

SEQ ID NO: 591 - protein, 453 aa, Artificial Sequence; identical to SEQ ID NO: 583
  source: /note="Description of Artificial Sequence: Synthetic polypeptide"

SEQ ID NO: 592 - protein, 453 aa, Artificial Sequence; identical to SEQ ID NO: 585
  source: /note="Description of Artificial Sequence: Synthetic polypeptide"

SEQ ID NO: 593 - protein, 453 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWISPNQGETNYAQKFQDRVTMTRDTSISTAYMELSSLRSDDTAVYYCAREATIFGMLIVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 594 - protein, 453 aa, Artificial Sequence; identical to SEQ ID NO: 593
  source: /note="Description of Artificial Sequence: Synthetic polypeptide"

SEQ ID NO: 595 - protein, 458 aa, Artificial Sequence; identical to SEQ ID NO: 472
  source: /note="Description of Artificial Sequence: Synthetic polypeptide"

SEQ ID NO: 596 - protein, 458 aa, Artificial Sequence; identical to SEQ ID NO: 472
  source: /note="Description of Artificial Sequence: Synthetic polypeptide"

SEQ ID NO: 597 - protein, 458 aa, Artificial Sequence; identical to SEQ ID NO: 472
  source: /note="Description of Artificial Sequence: Synthetic polypeptide"

SEQ ID NO: 598 - protein, 458 aa, Artificial Sequence; identical to SEQ ID NO: 472
  source: /note="Description of Artificial Sequence: Synthetic polypeptide"

SEQ ID NO: 599 - protein, 458 aa, Artificial Sequence; identical to SEQ ID NO: 472
  source: /note="Description of Artificial Sequence: Synthetic polypeptide"

SEQ ID NO: 600 - protein, 458 aa, Artificial Sequence; identical to SEQ ID NO: 472
  source: /note="Description of Artificial Sequence: Synthetic polypeptide"

SEQ ID NO: 601 - protein, 458 aa, Artificial Sequence; identical to SEQ ID NO: 472
  source: /note="Description of Artificial Sequence: Synthetic polypeptide"

SEQ ID NO: 602 - protein, 458 aa, Artificial Sequence; identical to SEQ ID NO: 472
  source: /note="Description of Artificial Sequence: Synthetic polypeptide"

SEQ ID NO: 603 - protein, 458 aa, Artificial Sequence; identical to SEQ ID NO: 472
  source: /note="Description of Artificial Sequence: Synthetic polypeptide"

SEQ ID NO: 604 - protein, 458 aa, Artificial Sequence; identical to SEQ ID NO: 472
  source: /note="Description of Artificial Sequence: Synthetic polypeptide"

SEQ ID NO: 605 - protein, 458 aa, Artificial Sequence; identical to SEQ ID NO: 472
  source: /note="Description of Artificial Sequence: Synthetic polypeptide"

SEQ ID NO: 606 - protein, 458 aa, Artificial Sequence; identical to SEQ ID NO: 472
  source: /note="Description of Artificial Sequence: Synthetic polypeptide"

SEQ ID NO: 607 - protein, 458 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 608 - protein, 458 aa, Artificial Sequence
  source: /note="Description of Artificial Sequence: Synthetic polypeptide"
QMQVVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 451 aa, Artificial Sequence; identical to SEQ ID NO: 509
  source: /note="Description of Artificial Sequence: Synthetic polypeptide"

SEQ ID NO: 610 - protein, 451 aa, Artificial Sequence; identical to SEQ ID NO: 491
  source: /note="Description of Artificial Sequence: Synthetic polypeptide"

SEQ ID NO: 611 - protein, 458 aa, Artificial Sequence; identical to SEQ ID NO: 472
  source: /note="Description of Artificial Sequence: Synthetic polypeptide"

SEQ ID NO: 612 - protein, 451 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 613 - protein, 459 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGNTGYAQKFQGRVTMTRDTSISTAYMELSSLRSQDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 451 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 615 - protein, 451 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDASNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - protein, 451 aa, Artificial Sequence; identical to SEQ ID NO: 614
  source: /note="Description of Artificial Sequence: Synthetic polypeptide"

SEQ ID NO: 617 - protein, 451 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADAVKGRFTISRDNSKNTLYLQMNSLRAEDSAMYFCARGKVAGMPEAFEIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 618 - protein, 451 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDASNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 619 - protein, 451 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDGSNKFHADAVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 459 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 459 aa, Artificial Sequence; identical to SEQ ID NO: 613
  source: /note="Description of Artificial Sequence: Synthetic polypeptide"

SEQ ID NO: 622 - protein, 459 aa, Artificial Sequence; identical to SEQ ID NO: 620
  source: /note="Description of Artificial Sequence: Synthetic polypeptide"

SEQ ID NO: 623 - protein, 459 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 624 - protein, 459 aa, Artificial Sequence; identical to SEQ ID NO: 620
  source: /note="Description of Artificial Sequence: Synthetic polypeptide"

SEQ ID NO: 625 - protein, 459 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGNTGYAQKFQGRVTMTRDTSISTAYMELSSLRSDDTAVYYCARGGDYVWGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 459 aa, Artificial Sequence
  source: /note="Description of Artificial Sequence: Synthetic polypeptide"
QMQLVQSGAEVKKPGASVKVSCKASGYTFTSYDINWVRQATGQGLEWMGWMNPNSGGTGYAQKFQGRVTMTRDTSISTAYMELSSLRSQDTAVYYCARGGDYVFGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 459 aa, Artificial Sequence
  source: /note="Description of Artificial Sequence: Synthetic polypeptide"
QMQLVQSGAEVKKPGASVKVSCKASGYTFTSYDINWVRQAPGQGLEWMGWMNPNSGGTGYAQKFQGRVTMTRDTSISTAYMELSSLRSDDTAVYYCARGGDYVFGSYRPYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 628 - protein, 451 aa, Artificial Sequence; identical to SEQ ID NO: 617
  source: /note="Description of Artificial Sequence: Synthetic polypeptide"

SEQ ID NO: 629 - protein, 13 aa, Artificial Sequence
  source: /note="Description of Artificial Sequence: Synthetic peptide"
SGSSSNIGSNTVN

SEQ ID NO: 630 - protein, 11 aa, Artificial Sequence
  source: /note="Description of Artificial Sequence: Synthetic peptide"
RASQDIRDYLG

SEQ ID NO: 631 - protein, 11 aa, Artificial Sequence
  source: /note="Description of Artificial Sequence: Synthetic peptide"
RASQDIRDYLG

SEQ ID NO: 632 - protein, 11 aa, Artificial Sequence
  source: /note="Description of Artificial Sequence: Synthetic peptide"
QASQDISNYLN

SEQ ID NO: 633 - protein, 17 aa, Artificial Sequence
  source: /note="Description of Artificial Sequence: Synthetic peptide"
KSSQSVLSSSNNKNYIA

SEQ ID NO: 634 - protein, 17 aa, Artificial Sequence
  source: /note="Description of Artificial Sequence: Synthetic peptide"
KSSQSVLSSSNNKNYIA

SEQ ID NO: 635 - protein, 17 aa, Artificial Sequence
  source: /note="Description of Artificial Sequence: Synthetic peptide"
KSSQSVLSSSNNKNYLA

SEQ ID NO: 636 - protein, 17 aa, Artificial Sequence
  source: /note="Description of Artificial Sequence: Synthetic peptide"
KSSQSVLSSSNNKNYLA

SEQ ID NO: 637 - protein, 12 aa, Artificial Sequence
  source: /note="Description of Artificial Sequence: Synthetic peptide"
RASQSISYSYLA

SEQ ID NO: 638 - protein, 11 aa, Artificial Sequence
  source: /note="Description of Artificial Sequence: Synthetic peptide"
RASQSVSSNLA

SEQ ID NO: 639 - protein, 11 aa, Artificial Sequence
  source: /note="Description of Artificial Sequence: Synthetic peptide"
RASQGIRNELG

SEQ ID NO: 640 - protein, 11 aa, Artificial Sequence
  source: /note="Description of Artificial Sequence: Synthetic peptide"
QASQDITNYLN

SEQ ID NO: 641 - protein, 11 aa, Artificial Sequence
  source: /note="Description of Artificial Sequence: Synthetic peptide"
RASQGLIIWLA

SEQ ID NO: 642 - protein, 11 aa, Artificial Sequence
  source: /note="Description of Artificial Sequence: Synthetic peptide"
RASQGLIIWLA

SEQ ID NO: 643 - protein, 11 aa, Artificial Sequence
  source: /note="Description of Artificial Sequence: Synthetic peptide"
RASQGIRNELG

SEQ ID NO: 644 - protein, 11 aa, Artificial Sequence
  source: /note="Description of Artificial Sequence: Synthetic peptide"
RASQGIRNELG

SEQ ID NO: 645 - protein, 11 aa, Artificial Sequence
  source: /note="Description of Artificial Sequence: Synthetic peptide"
RASQGIRNELG

SEQ ID NO: 646 - protein, 11 aa, Artificial Sequence
  source: /note="Description of Artificial Sequence: Synthetic peptide"
RASQGIRNELG

SEQ ID NO: 647 - protein, 11 aa, Artificial Sequence
  source: /note="Description of Artificial Sequence: Synthetic peptide"
RASQGIRNELG

SEQ ID NO: 648 - protein, 11 aa, Artificial Sequence
  source: /note="Description of Artificial Sequence: Synthetic peptide"
RASQGIRNELG

SEQ ID NO: 649 - protein, 11 aa, Artificial Sequence
  source: /note="Description of Artificial Sequence: Synthetic peptide"
RASQDIRDYLG

SEQ ID NO: 650 - protein, 11 aa, Artificial Sequence
  source: /note="Description of Artificial Sequence: Synthetic peptide"
RASQDIRDYLG

SEQ ID NO: 651 - protein, 11 aa, Artificial Sequence
  source: /note="Description of Artificial Sequence: Synthetic peptide"
RASQDIRDYLG

SEQ ID NO: 652 - protein, 11 aa, Artificial Sequence
  source: /note="Description of Artificial Sequence: Synthetic peptide"
RASQDIRDYLG

SEQ ID NO: 653 - protein, 11 aa, Artificial Sequence
  source: /note="Description of Artificial Sequence: Synthetic peptide"
RASQDIRDYLG

SEQ ID NO: 654 - protein, 11 aa, Artificial Sequence
  source: /note="Description of Artificial Sequence: Synthetic peptide"
RASQDIRDYLG

SEQ ID NO: 655 - protein, 11 aa, Artificial Sequence
  source: /note="Description of Artificial Sequence: Synthetic peptide"
RASQDIRDYLG

SEQ ID NO: 656 - protein, 11 aa, Artificial Sequence
  source: /note="Description of Artificial Sequence: Synthetic peptide"
RASQDLRNYLG

SEQ ID NO: 657 - protein, 11 aa, Artificial Sequence
  source: /note="Description of Artificial Sequence: Synthetic peptide"
RASQDLRNYLG

SEQ ID NO: 658 - protein, 11 aa, Artificial Sequence
  source: /note="Description of Artificial Sequence: Synthetic peptide"
RASQDLRNYLG

SEQ ID NO: 659 - protein, 11 aa, Artificial Sequence
  source: /note="Description of Artificial Sequence: Synthetic peptide"
RASQDLRNYLG

SEQ ID NO: 660 - protein, 11 aa, Artificial Sequence
  source: /note="Description of Artificial Sequence: Synthetic peptide"
RASQDLRNYLG

SEQ ID NO: 661 - protein, 11 aa, Artificial Sequence
  source: /note="Description of Artificial Sequence: Synthetic peptide"
RASQDLRNYLG

SEQ ID NO: 662 - protein, 11 aa, Artificial Sequence
  source: /note="Description of Artificial Sequence: Synthetic peptide"
RASQDLRNYLG

SEQ ID NO: 663 - protein, 11 aa, Artificial Sequence
  source: /note="Description of Artificial Sequence: Synthetic peptide"
RASQDLRNYLG

SEQ ID NO: 664 - protein, 11 aa, Artificial Sequence
  source: /note="Description of Artificial Sequence: Synthetic peptide"
RASQDLRNYLG

SEQ ID NO: 665 - protein, 11 aa, Artificial Sequence
  source: /note="Description of Artificial Sequence: Synthetic peptide"
RASQDLRNYLG

SEQ ID NO: 666 - protein, 11 aa, Artificial Sequence
  source: /note="Description of Artificial Sequence: Synthetic peptide"
RASQDLRNYLG

SEQ ID NO: 667 - protein, 11 aa, Artificial Sequence
  source: /note="Description of Artificial Sequence: Synthetic peptide"
RASQDLRNYLG

SEQ ID NO: 668 - protein, 11 aa, Artificial Sequence
  source: /note="Description of Artificial Sequence: Synthetic peptide"
QASQDISNYLN

SEQ ID NO: 669 - protein, 11 aa, Artificial Sequence
  source: /note="Description of Artificial Sequence: Synthetic peptide"
QASQDISNYLN

SEQ ID NO: 670 - protein, 11 aa, Artificial Sequence
  source: /note="Description of Artificial Sequence: Synthetic peptide"
QASQDISNYLN

SEQ ID NO: 671 - protein, 11 aa, Artificial Sequence
  source: /note="Description of Artificial Sequence: Synthetic peptide"
QASQDISNYLN

SEQ ID NO: 672 - protein, 11 aa, Artificial Sequence
  source: /note="Description of Artificial Sequence: Synthetic peptide"
QASQDISNYLN

SEQ ID NO: 673 - protein, 11 aa, Artificial Sequence
  source: /note="Description of Artificial Sequence: Synthetic peptide"
QASQDISNYLN

SEQ ID NO: 674 - protein, 11 aa, Artificial Sequence
  source: /note="Description of Artificial Sequence: Synthetic peptide"
QASQDISNYLN

SEQ ID NO: 675 - protein, 11 aa, Artificial Sequence
  source: /note="Description of Artificial Sequence: Synthetic peptide"
QASQDISNYLN

SEQ ID NO: 676 - protein, 11 aa, Artificial Sequence
  source: /note="Description of Artificial Sequence: Synthetic peptide"
QASQDISNYLN

SEQ ID NO: 677 - protein, 11 aa, Artificial Sequence
  source: /note="Description of Artificial Sequence: Synthetic peptide"
RASQDIRDYLG

SEQ ID NO: 678 - protein, 11 aa, Artificial Sequence
  source: /note="Description of Artificial Sequence: Synthetic peptide"
RASQDIRDYLG

SEQ ID NO: 679 - protein, 11 aa, Artificial Sequence
  source: /note="Description of Artificial Sequence: Synthetic peptide"
RASQDIRDYLG

SEQ ID NO: 680 - protein, 11 aa, Artificial Sequence
  source: /note="Description of Artificial Sequence: Synthetic peptide"
RASQDIRDYLG

SEQ ID NO: 681 - protein, 11 aa, Artificial Sequence
  source: /note="Description of Artificial Sequence: Synthetic peptide"
RASQDIRDYLG

SEQ ID NO: 682 - protein, 11 aa, Artificial Sequence
  source: /note="Description of Artificial Sequence: Synthetic peptide"
RASQDIRDYLG

SEQ ID NO: 683 - protein, 11 aa, Artificial Sequence
  source: /note="Description of Artificial Sequence: Synthetic peptide"
RASQDIRDYLG

SEQ ID NO: 684 - protein, 11 aa, Artificial Sequence
  source: /note="Description of Artificial Sequence: Synthetic peptide"
QASQDITNYLN

SEQ ID NO: 685 - protein, 11 aa, Artificial Sequence
  source: /note="Description of Artificial Sequence: Synthetic peptide"
QASQDITNYLN

SEQ ID NO: 686 - protein, 11 aa, Artificial Sequence
  source: /note="Description of Artificial Sequence: Synthetic peptide"
QASQDITNYLN

SEQ ID NO: 687 - protein, 11 aa, Artificial Sequence
  source: /note="Description of Artificial Sequence: Synthetic peptide"
QASQDITNYLN

SEQ ID NO: 688 - protein, 11 aa, Artificial Sequence
  source: /note="Description of Artificial Sequence: Synthetic peptide"
QASQDITNYLN

SEQ ID NO: 689 - protein, 11 aa, Artificial Sequence
  source: /note="Description of Artificial Sequence: Synthetic peptide"
QASQDITNYLN

SEQ ID NO: 690 - protein, 11 aa, Artificial Sequence
  source: /note="Description of Artificial Sequence: Synthetic peptide"
QASQDITNYLN

SEQ ID NO: 691 - protein, 11 aa, Artificial Sequence
  source: /note="Description of Artificial Sequence: Synthetic peptide"
QASQDITNYLN

SEQ ID NO: 692 - protein, 11 aa, Artificial Sequence
  source: /note="Description of Artificial Sequence: Synthetic peptide"
QASQDITNYLN

SEQ ID NO: 693 - protein, 11 aa, Artificial Sequence
  source: /note="Description of Artificial Sequence: Synthetic peptide"
QASQDITNYLN

SEQ ID NO: 694 - protein, 11 aa, Artificial Sequence
  source: /note="Description of Artificial Sequence: Synthetic peptide"
QASQDITNYLN

SEQ ID NO: 695 - protein, 12 aa, Artificial Sequence
  source: /note="Description of Artificial Sequence: Synthetic peptide"
RASQIFTSTYLA

SEQ ID NO: 696 - protein, 12 aa, Artificial Sequence
  source: /note="Description of Artificial Sequence: Synthetic peptide"
RASQIFTSTYLA

SEQ ID NO: 697 - protein, 12 aa, Artificial Sequence
  source: /note="Description of Artificial Sequence: Synthetic peptide"
RASQIFTSTYLA

SEQ ID NO: 698 - protein, 12 aa, Artificial Sequence
  source: /note="Description of Artificial Sequence: Synthetic peptide"
RASQIFTSTYLA

SEQ ID NO: 699 - protein, 11 aa, Artificial Sequence
  source: /note="Description of Artificial Sequence: Synthetic peptide"
RASQSVSSNLA

SEQ ID NO: 700 - protein, 11 aa, Artificial Sequence
  source: /note="Description of Artificial Sequence: Synthetic peptide"
RASQSVSSNLA

SEQ ID NO: 701 - protein, 11 aa, Artificial Sequence
  source: /note="Description of Artificial Sequence: Synthetic peptide"
RASQSVSSNLA

SEQ ID NO: 702 - protein, 11 aa, Artificial Sequence
  source: /note="Description of Artificial Sequence: Synthetic peptide"
RASQSVSSNLA

SEQ ID NO: 703 - protein, 11 aa, Artificial Sequence
  source: /note="Description of Artificial Sequence: Synthetic peptide"
RASQSVSSNLA

SEQ ID NO: 704 - protein, 11 aa, Artificial Sequence
  source: /note="Description of Artificial Sequence: Synthetic peptide"
RASQSVSSNLA

SEQ ID NO: 705 - protein, 11 aa, Artificial Sequence
  source: /note="Description of Artificial Sequence: Synthetic peptide"
RASQSVSSNLA

SEQ ID NO: 706 - protein, 11 aa, Artificial Sequence
  source: /note="Description of Artificial Sequence: Synthetic peptide"
RASQSVSSNLA

SEQ ID NO: 707 - protein, 12 aa, Artificial Sequence
  source: /note="Description of Artificial Sequence: Synthetic peptide"
RASQSISYSYLA

SEQ ID NO: 708 - protein, 12 aa, Artificial Sequence
  source: /note="Description of Artificial Sequence: Synthetic peptide"
RASQSISYSYLA

SEQ ID NO: 709 - protein, 12 aa, Artificial Sequence
  source: /note="Description of Artificial Sequence: Synthetic peptide"
RASQSISYSYLA

SEQ ID NO: 710 - protein, 12 aa, Artificial Sequence
  source: /note="Description of Artificial Sequence: Synthetic peptide"
RASQSISYSYLA

SEQ ID NO: 711 - protein, 12 aa, Artificial Sequence
  source: /note="Description of Artificial Sequence: Synthetic peptide"
RASQSISYSYLA

SEQ ID NO: 712 - protein, 12 aa, Artificial Sequence
  source: /note="Description of Artificial Sequence: Synthetic peptide"
RASQSISYSYLA

SEQ ID NO: 713 - protein, 12 aa, Artificial Sequence
  source: /note="Description of Artificial Sequence: Synthetic peptide"
RASQSISYSYLA

SEQ ID NO: 714 - protein, 17 aa, Artificial Sequence
  source: /note="Description of Artificial Sequence: Synthetic peptide"
KSSQSVLSSSNNKNYIA

SEQ ID NO: 715 - protein, 17 aa, Artificial Sequence
  source: /note="Description of Artificial Sequence: Synthetic peptide"
KSSQSVLSSSNNKNYIA

SEQ ID NO: 716 - protein, 17 aa, Artificial Sequence
  source: /note="Description of Artificial Sequence: Synthetic peptide"
KSSQSVLSSSNNKNYIA

SEQ ID NO: 717 - protein, 17 aa, Artificial Sequence
  source: /note="Description of Artificial Sequence: Synthetic peptide"
KSSQSVLSSSNNKNYIA

SEQ ID NO: 718 - protein, 17 aa, Artificial Sequence
  source: /note="Description of Artificial Sequence: Synthetic peptide"
KSSQSVLSSSNNKNYIA

SEQ ID NO: 719 - protein, 17 aa, Artificial Sequence
  source: /note="Description of Artificial Sequence: Synthetic peptide"
KSSQSVLSSSNNKNYIA

SEQ ID NO: 720 - protein, 17 aa, Artificial Sequence
  source: /note="Description of Artificial Sequence: Synthetic peptide"
KSSQSVLSSSNNKNYIA

SEQ ID NO: 721 - protein, 17 aa, Artificial Sequence
  source: /note="Description of Artificial Sequence: Synthetic peptide"
KSSQSVLSSSNNKNYIA

SEQ ID NO: 722 - protein, 17 aa, Artificial Sequence
  source: /note="Description of Artificial Sequence: Synthetic peptide"
KSSQSVLSSSNNKNYIA

SEQ ID NO: 723 - protein, 17 aa, Artificial Sequence
  source: /note="Description of Artificial Sequence: Synthetic peptide"
KSSQSVLSSSNNKNYIA

SEQ ID NO: 724 - protein, 17 aa, Artificial Sequence
  source: /note="Description of Artificial Sequence: Synthetic peptide"
KSSQSVLSSSNNKNYIA

SEQ ID NO: 725 - protein, 17 aa, Artificial Sequence
  source: /note="Description of Artificial Sequence: Synthetic peptide"
KSSQSVLSSSNNKNYLA

SEQ ID NO: 726 - protein, 17 aa, Artificial Sequence
  source: /note="Description of Artificial Sequence: Synthetic peptide"
KSSQSVLSSSNNKNYLA

SEQ ID NO: 727 - protein, 17 aa, Artificial Sequence
  source: /note="Description of Artificial Sequence: Synthetic peptide"
KSSQSVLSSSNNKNYLA

SEQ ID NO: 728 - protein, 17 aa, Artificial Sequence
  source: /note="Description of Artificial Sequence: Synthetic peptide"
KSSQSVLSSSNNKNYLA

SEQ ID NO: 729 - protein, 17 aa, Artificial Sequence
  source: /note="Description of Artificial Sequence: Synthetic peptide"
KSSQSVLSSSNNKNYLA

SEQ ID NO: 730 - protein, 17 aa, Artificial Sequence
  source: /note="Description of Artificial Sequence: Synthetic peptide"
KSSQSVLSSSNNKNYLA

SEQ ID NO: 731 - protein, 17 aa, Artificial Sequence
  source: /note="Description of Artificial Sequence: Synthetic peptide"
KSSQSVLSSSNNKNYLA

SEQ ID NO: 732 - protein, 17 aa, Artificial Sequence
  source: /note="Description of Artificial Sequence: Synthetic peptide"
KSSQSVLSSSNNKNYLA

SEQ ID NO: 733 - protein, 17 aa, Artificial Sequence
  source: /note="Description of Artificial Sequence: Synthetic peptide"
KSSQSVLSSSNNKNYLA

SEQ ID NO: 734 - protein, 17 aa, Artificial Sequence
  source: /note="Description of Artificial Sequence: Synthetic peptide"
KSSQSVLSSSNNKNYIA

SEQ ID NO: 735 - protein, 17 aa, Artificial Sequence
  source: /note="Description of Artificial Sequence: Synthetic peptide"
KSSQSVLSSSNNKNYIA

SEQ ID NO: 736 - protein, 17 aa, Artificial Sequence
  source: /note="Description of Artificial Sequence: Synthetic peptide"
KSSQSVLSSSNNKNYIA

SEQ ID NO: 737 - protein, 17 aa, Artificial Sequence
  source: /note="Description of Artificial Sequence: Synthetic peptide"
KSSQSVLSSSNNKNYIA

SEQ ID NO: 738 - protein, 17 aa, Artificial Sequence
  source: /note="Description of Artificial Sequence: Synthetic peptide"
KSSQSVLSSSNNKNYIA

SEQ ID NO: 739 - protein, 17 aa, Artificial Sequence
  source: /note="Description of Artificial Sequence: Synthetic peptide"
KSSQSVLSSSNNKNYLA

SEQ ID NO: 740 - protein, 17 aa, Artificial Sequence
  source: /note="Description of Artificial Sequence: Synthetic peptide"
KSSQSVLSSSNNKNYLA

SEQ ID NO: 741 - protein, 17 aa, Artificial Sequence
  source: /note="Description of Artificial Sequence: Synthetic peptide"
KSSQSVLSSSNNKNYLA

SEQ ID NO: 742 - protein, 17 aa, Artificial Sequence
  source: /note="Description of Artificial Sequence: Synthetic peptide"
KSSQSVLSSSNNKNYLA

SEQ ID NO: 743 - protein, 17 aa, Artificial Sequence
  source: /note="Description of Artificial Sequence: Synthetic peptide"
KSSQSVLSSSNNKNYLA

SEQ ID NO: 744 - protein, 17 aa, Artificial Sequence
  source: /note="Description of Artificial Sequence: Synthetic peptide"
KSSQSVLSSSNNKNYLA

SEQ ID NO: 745 - protein, 17 aa, Artificial Sequence
  source: /note="Description of Artificial Sequence: Synthetic peptide"
KSSQSVLSSSNNKNYLA

SEQ ID NO: 746 - protein, 17 aa, Artificial Sequence
  source: /note="Description of Artificial Sequence: Synthetic peptide"
KSSQSVLSSSNNKNYLA

SEQ ID NO: 747 - protein, 17 aa, Artificial Sequence
  source: /note="Description of Artificial Sequence: Synthetic peptide"
KSSQSVLSSSNNKNYLA

SEQ ID NO: 748 - protein, 17 aa, Artificial Sequence
  source: /note="Description of Artificial Sequence: Synthetic peptide"
KSSQSVLSSSNNKNYLA

SEQ ID NO: 749 - protein, 17 aa, Artificial Sequence
  source: /note="Description of Artificial Sequence: Synthetic peptide"
KSSQSVLSSSNNKNYLA

SEQ ID NO: 750 - protein, 17 aa, Artificial Sequence
  source: /note="Description of Artificial Sequence: Synthetic peptide"
KSSQSVLSSSNNKNYLA

SEQ ID NO: 751 - protein, 17 aa, Artificial Sequence
  source: /note="Description of Artificial Sequence: Synthetic peptide"
KSSQSVLSSSNNKNYLA

SEQ ID NO: 752 - protein, 13 aa, Artificial Sequence
  source: /note="Description of Artificial Sequence: Synthetic peptide"
SGSSSNIGSQTVN

SEQ ID NO: 753 - protein, 13 aa, Artificial Sequence
  source: /note="Description of Artificial Sequence: Synthetic peptide"
SGSSSNIGSQTVN

SEQ ID NO: 754 - protein, 13 aa, Artificial Sequence
  source: /note="Description of Artificial Sequence: Synthetic peptide"
SGSSSNIGSNYVN

SEQ ID NO: 755 - protein, 13 aa, Artificial Sequence
  source: /note="Description of Artificial Sequence: Synthetic peptide"
SGSSSNIGSNYVN

SEQ ID NO: 756 - protein, 13 aa, Artificial Sequence
  source: /note="Description of Artificial Sequence: Synthetic peptide"
SGSSSNIGSQTVN

SEQ ID NO: 757 - protein, 13 aa, Artificial Sequence
  source: /note="Description of Artificial Sequence: Synthetic peptide"
SGSSSNIGSNYVN

SEQ ID NO: 758 - protein, 13 aa, Artificial Sequence
  source: /note="Description of Artificial Sequence: Synthetic peptide"
SGSSSNIGSNTVN

SEQ ID NO: 759 - protein, 13 aa, Artificial Sequence
  source: /note="Description of Artificial Sequence: Synthetic peptide"
SGSSSNIGSNTVN

SEQ ID NO: 760 - protein, 13 aa, Artificial Sequence
  source: /note="Description of Artificial Sequence: Synthetic peptide"
SGSSSNIGSNTVN

SEQ ID NO: 761 - protein, 13 aa, Artificial Sequence
  source: /note="Description of Artificial Sequence: Synthetic peptide"
SGSSSNIGSNTVN

SEQ ID NO: 762 - protein, 13 aa, Artificial Sequence
  source: /note="Description of Artificial Sequence: Synthetic peptide"
SGSSSNIGSNTVN

SEQ ID NO: 763 - protein, 13 aa, Artificial Sequence
  source: /note="Description of Artificial Sequence: Synthetic peptide"
SGSSSNIGSNYVN

SEQ ID NO: 764 - protein, 13 aa, Artificial Sequence
  source: /note="Description of Artificial Sequence: Synthetic peptide"
SGSSSNIGSNYVN

SEQ ID NO: 765 - protein, 13 aa, Artificial Sequence
  source: /note="Description of Artificial Sequence: Synthetic peptide"
SGSSSNIGSQTVN

SEQ ID NO: 766 - protein, 11 aa, Artificial Sequence
  source: /note="Description of Artificial Sequence: Synthetic peptide"
RASQDLRNYLG

SEQ ID NO: 767 - protein, 11 aa, Artificial Sequence
  source: /note="Description of Artificial Sequence: Synthetic peptide"
RASQDIRDYLG

SEQ ID NO: 768 - protein, 13 aa, Artificial Sequence
  source: /note="Description of Artificial Sequence: Synthetic peptide"
SGSSSNIGSNTVN

SEQ ID NO: 769 - protein, 11 aa, Artificial Sequence
  source: /note="Description of Artificial Sequence: Synthetic peptide"
RASQTISRFLN

SEQ ID NO: 770 - protein, 13 aa, Artificial Sequence
  source: /note="Description of Artificial Sequence: Synthetic peptide"
SGSSSNIGNNYVS

SEQ ID NO: 771 - protein, 11 aa, Artificial Sequence
  source: /note="Description of Artificial Sequence: Synthetic peptide"
RASQTISRFLN

SEQ ID NO: 772 - protein, 11 aa, Artificial Sequence
  source: /note="Description of Artificial Sequence: Synthetic peptide"
RASQTISRFLN

SEQ ID NO: 773 - protein, 11 aa, Artificial Sequence
  source: /note="Description of Artificial Sequence: Synthetic peptide"
RASQTISRFLN

SEQ ID NO: 774 - protein, 11 aa, Artificial Sequence
  source: /note="Description of Artificial Sequence: Synthetic peptide"
RASQTISRFLN

SEQ ID NO: 775 - protein, 11 aa, Artificial Sequence
  source: /note="Description of Artificial Sequence: Synthetic peptide"
RASQTISRFLN

SEQ ID NO: 776 - protein, 11 aa, Artificial Sequence
  source: /note="Description of Artificial Sequence: Synthetic peptide"
RASQTISRFLN

SEQ ID NO: 777 - protein, 13 aa, Artificial Sequence
  source: /note="Description of Artificial Sequence: Synthetic peptide"
SGSSSNIGNNYVS

SEQ ID NO: 778 - protein, 13 aa, Artificial Sequence
  source: /note="Description of Artificial Sequence: Synthetic peptide"
SGSSSNIGNNYVS

SEQ ID NO: 779 - protein, 13 aa, Artificial Sequence
  source: /note="Description of Artificial Sequence: Synthetic peptide"
SGSSSNIGNNYVS

SEQ ID NO: 780 - protein, 13 aa, Artificial Sequence
  source: /note="Description of Artificial Sequence: Synthetic peptide"
SGSSSNIGNNYVS

SEQ ID NO: 781 - protein, 13 aa, Artificial Sequence
  source: /note="Description of Artificial Sequence: Synthetic peptide"
SGSSSNIGNNYVS

SEQ ID NO: 782 - protein, 13 aa, Artificial Sequence
  source: /note="Description of Artificial Sequence: Synthetic peptide"
SGSSSNIGNNYVS

SEQ ID NO: 783 - protein, 13 aa, Artificial Sequence
  source: /note="Description of Artificial Sequence: Synthetic peptide"
SGSSSNIGNNYVS

SEQ ID NO: 784 - protein, 13 aa, Artificial Sequence
  source: /note="Description of Artificial Sequence: Synthetic peptide"
SGSSSNIGNNYVS

SEQ ID NO: 785 - protein, 11 aa, Artificial Sequence
  source: /note="Description of Artificial Sequence: Synthetic peptide"
RASQTISRFLN

SEQ ID NO: 786 - protein, 7 aa, Artificial Sequence
  source: /note="Description of Artificial Sequence: Synthetic peptide"
TNNQRPS

SEQ ID NO: 787 - protein, 7 aa, Artificial Sequence
  source: /note="Description of Artificial Sequence: Synthetic peptide"
GASSLQS

SEQ ID NO: 788 - protein, 7 aa, Artificial Sequence
  source: /note="Description of Artificial Sequence: Synthetic peptide"
GASSLQS

SEQ ID NO: 789 - protein, 7 aa, Artificial Sequence
  source: /note="Description of Artificial Sequence: Synthetic peptide"
DASNLET

SEQ ID NO: 790 - protein, 7 aa, Artificial Sequence
  source: /note="Description of Artificial Sequence: Synthetic peptide"
WASTRES

SEQ ID NO: 791 - protein, 7 aa, Artificial Sequence
  source: /note="Description of Artificial Sequence: Synthetic peptide"
WASTRES

SEQ ID NO: 792 - protein, 7 aa, Artificial Sequence
  source: /note="Description of Artificial Sequence: Synthetic peptide"
WTSTRDS

SEQ ID NO: 793 - protein, 7 aa, Artificial Sequence
  source: /note="Description of Artificial Sequence: Synthetic peptide"
WTSTRDS

SEQ ID NO: 794 - protein, 7 aa, Artificial Sequence
  source: /note="Description of Artificial Sequence: Synthetic peptide"
GASSRAT

SEQ ID NO: 795 - protein, 7 aa, Artificial Sequence
  source: /note="Description of Artificial Sequence: Synthetic peptide"
GAATRAT

SEQ ID NO: 796 - protein, 7 aa, Artificial Sequence
  source: /note="Description of Artificial Sequence: Synthetic peptide"
GASSLQS

SEQ ID NO: 797 - protein, 7 aa, Artificial Sequence
  source: /note="Description of Artificial Sequence: Synthetic peptide"
DASNLEP

SEQ ID NO: 798 - protein, 7 aa, Artificial Sequence
  source: /note="Description of Artificial Sequence: Synthetic peptide"
AASSLQS

SEQ ID NO: 799 - protein, 7 aa, Artificial Sequence
  source: /note="Description of Artificial Sequence: Synthetic peptide"
AASSLQS

SEQ ID NO: 800 - protein, 7 aa, Artificial Sequence
  source: /note="Description of Artificial Sequence: Synthetic peptide"
GASSLQS

SEQ ID NO: 801 - protein, 7 aa, Artificial Sequence
  source: /note="Description of Artificial Sequence: Synthetic peptide"
GASSLQS

SEQ ID NO: 802 - protein, 7 aa, Artificial Sequence
  source: /note="Description of Artificial Sequence: Synthetic peptide"
GASSLQS

SEQ ID NO: 803 - protein, 7 aa, Artificial Sequence
  source: /note="Description of Artificial Sequence: Synthetic peptide"
GASSLQS

SEQ ID NO: 804 - protein, 7 aa, Artificial Sequence
  source: /note="Description of Artificial Sequence: Synthetic peptide"
GASSLQS

SEQ ID NO: 805 - protein, 7 aa, Artificial Sequence
  source: /note="Description of Artificial Sequence: Synthetic peptide"
GASSLQS

SEQ ID NO: 806 - protein, 7 aa, Artificial Sequence
  source: /note="Description of Artificial Sequence: Synthetic peptide"
GASSLQS

SEQ ID NO: 807 - protein, 7 aa, Artificial Sequence
  source: /note="Description of Artificial Sequence: Synthetic peptide"
GASSLQS

SEQ ID NO: 808 - protein, 7 aa, Artificial Sequence
  source: /note="Description of Artificial Sequence: Synthetic peptide"
GASSLQS

SEQ ID NO: 809 - protein, 7 aa, Artificial Sequence
  source: /note="Description of Artificial Sequence: Synthetic peptide"
GASSLQS

SEQ ID NO: 810 - protein, 7 aa, Artificial Sequence
  source: /note="Description of Artificial Sequence: Synthetic peptide"
GASSLQS

SEQ ID NO: 811 - protein, 7 aa, Artificial Sequence
  source: /note="Description of Artificial Sequence: Synthetic peptide"
GASSLQS

SEQ ID NO: 812 - protein, 7 aa, Artificial Sequence
  source: /note="Description of Artificial Sequence: Synthetic peptide"
GASSLQS

SEQ ID NO: 813 - protein, 7 aa, Artificial Sequence
  source: /note="Description of Artificial Sequence: Synthetic peptide"
GASSLQS

SEQ ID NO: 814 - protein, 7 aa, Artificial Sequence
  source: /note="Description of Artificial Sequence: Synthetic peptide"
GASSLQS

SEQ ID NO: 815 - protein, 7 aa, Artificial Sequence
  source: /note="Description of Artificial Sequence: Synthetic peptide"
GASSLQS

SEQ ID NO: 816 - protein, 7 aa, Artificial Sequence
  source: /note="Description of Artificial Sequence: Synthetic peptide"
GASSLQS

SEQ ID NO: 817 - protein, 7 aa, Artificial Sequence
  source: /note="Description of Artificial Sequence: Synthetic peptide"
GASSLQS

SEQ ID NO: 818 - protein, 7 aa, Artificial Sequence
  source: /note="Description of Artificial Sequence: Synthetic peptide"
GASSLQS

SEQ ID NO: 819 - protein, 7 aa, Artificial Sequence
  source: /note="Description of Artificial Sequence: Synthetic peptide"
GASSLQS

SEQ ID NO: 820 - protein, 7 aa, Artificial Sequence
  source: /note="Description of Artificial Sequence: Synthetic peptide"
GASSLQS

SEQ ID NO: 821 - protein, 7 aa, Artificial Sequence
  source: /note="Description of Artificial Sequence: Synthetic peptide"
GASSLQS

SEQ ID NO: 822 - protein, 7 aa, Artificial Sequence
  source: /note="Description of Artificial Sequence: Synthetic peptide"
GASSLQS

SEQ ID NO: 823 - protein, 7 aa, Artificial Sequence
  source: /note="Description of Artificial Sequence: Synthetic peptide"
GASSLQS

SEQ ID NO: 824 - protein, 7 aa, Artificial Sequence
  source: /note="Description of Artificial Sequence: Synthetic peptide"
GASSLQS

SEQ ID NO: 825 - protein, 7 aa, Artificial Sequence
  source: /note="Description of Artificial Sequence: Synthetic peptide"
DASNLET

SEQ ID NO: 826 - protein, 7 aa, Artificial Sequence
  source: /note="Description of Artificial Sequence: Synthetic peptide"
DASNLET

SEQ ID NO: 827 - protein, 7 aa, Artificial Sequence
  source: /note="Description of Artificial Sequence: Synthetic peptide"
DASNLET

SEQ ID NO: 828 - protein, 7 aa, Artificial Sequence
  source: /note="Description of Artificial Sequence: Synthetic peptide"
DASNLET

SEQ ID NO: 829 - protein, 7 aa, Artificial Sequence
  source: /note="Description of Artificial Sequence: Synthetic peptide"
DASNLET

SEQ ID NO: 830 - protein, 7 aa, Artificial Sequence
  source: /note="Description of Artificial Sequence: Synthetic peptide"
DASNLET

SEQ ID NO: 831 - protein, 7 aa, Artificial Sequence
  source: /note="Description of Artificial Sequence: Synthetic peptide"
DASNLET

SEQ ID NO: 832 - protein, 7 aa, Artificial Sequence
  source: /note="Description of Artificial Sequence: Synthetic peptide"
DASNLET

SEQ ID NO: 833 - protein, 7 aa, Artificial Sequence
  source: /note="Description of Artificial Sequence: Synthetic peptide"
DASNLET

SEQ ID NO: 834 - protein, 7 aa, Artificial Sequence
  source: /note="Description of Artificial Sequence: Synthetic peptide"
GASSLQS

SEQ ID NO: 835 - protein, 7 aa, Artificial Sequence
  source: /note="Description of Artificial Sequence: Synthetic peptide"
GASSLQS

SEQ ID NO: 836 - protein, 7 aa, Artificial Sequence
  source: /note="Description of Artificial Sequence: Synthetic peptide"
GASSLQS

SEQ ID NO: 837 - protein, 7 aa, Artificial Sequence
  source: /note="Description of Artificial Sequence: Synthetic peptide"
GASSLQS

SEQ ID NO: 838 - protein, 7 aa, Artificial Sequence
  source: /note="Description of Artificial Sequence: Synthetic peptide"
GASSLQS

SEQ ID NO: 839 - protein, 7 aa, Artificial Sequence
  source: /note="Description of Artificial Sequence: Synthetic peptide"
GASSLQS

SEQ ID NO: 840 - protein, 7 aa, Artificial Sequence
  source: /note="Description of Artificial Sequence: Synthetic peptide"
GASSLQS

SEQ ID NO: 841 - protein, 7 aa, Artificial Sequence
  source: /note="Description of Artificial Sequence: Synthetic peptide"
DASNLEP

SEQ ID NO: 842 - protein, 7 aa, Artificial Sequence
  source: /note="Description of Artificial Sequence: Synthetic peptide"
DASNLEP

SEQ ID NO: 843 - protein, 7 aa, Artificial Sequence
  source: /note="Description of Artificial Sequence: Synthetic peptide"
DASNLEP

SEQ ID NO: 844 - protein, 7 aa, Artificial Sequence
  source: /note="Description of Artificial Sequence: Synthetic peptide"
DASNLEP

SEQ ID NO: 845 - protein, 7 aa, Artificial Sequence
  source: /note="Description of Artificial Sequence: Synthetic peptide"
DASNLEP

SEQ ID NO: 846 - protein, 7 aa, Artificial Sequence
  source: /note="Description of Artificial Sequence: Synthetic peptide"
DASNLEP

SEQ ID NO: 847 - protein, 7 aa, Artificial Sequence
  source: /note="Description of Artificial Sequence: Synthetic peptide"
DASNLEP

SEQ ID NO: 848 - protein, 7 aa, Artificial Sequence
  source: /note="Description of Artificial Sequence: Synthetic peptide"
DASNLEP

SEQ ID NO: 849 - protein, 7 aa, Artificial Sequence
  source: /note="Description of Artificial Sequence: Synthetic peptide"
DASNLEP

SEQ ID NO: 850 - protein, 7 aa, Artificial Sequence
  source: /note="Description of Artificial Sequence: Synthetic peptide"
DASNLEP

SEQ ID NO: 851 - protein, 7 aa, Artificial Sequence
  source: /note="Description of Artificial Sequence: Synthetic peptide"
DASNLEP

SEQ ID NO: 852 - protein, 7 aa, Artificial Sequence
  source: /note="Description of Artificial Sequence: Synthetic peptide"
GASSRAT

SEQ ID NO: 853 - protein, 7 aa, Artificial Sequence
  source: /note="Description of Artificial Sequence: Synthetic peptide"
GASSRAT

SEQ ID NO: 854 - protein, 7 aa, Artificial Sequence
  source: /note="Description of Artificial Sequence: Synthetic peptide"
GASSRAT

SEQ ID NO: 855 - protein, 7 aa, Artificial Sequence
  source: /note="Description of Artificial Sequence: Synthetic peptide"
GASSRAT

SEQ ID NO: 856 - protein, 7 aa, Artificial Sequence
  source: /note="Description of Artificial Sequence: Synthetic peptide"
GAATRAT

SEQ ID NO: 857 - protein, 7 aa, Artificial Sequence
  source: /note="Description of Artificial Sequence: Synthetic peptide"
GAATRAT

SEQ ID NO: 858 - protein, 7 aa, Artificial Sequence
  source: /note="Description of Artificial Sequence: Synthetic peptide"
GAATRAT

SEQ ID NO: 859 - protein, 7 aa, Artificial Sequence
  source: /note="Description of Artificial Sequence: Synthetic peptide"
GAATRAT

SEQ ID NO: 860 - protein, 7 aa, Artificial Sequence
  source: /note="Description of Artificial Sequence: Synthetic peptide"
GAATRAT

SEQ ID NO: 861 - protein, 7 aa, Artificial Sequence
  source: /note="Description of Artificial Sequence: Synthetic peptide"
GAATRAT

SEQ ID NO: 862 - protein, 7 aa, Artificial Sequence
  source: /note="Description of Artificial Sequence: Synthetic peptide"
GAATRAT

SEQ ID NO: 863 - protein, 7 aa, Artificial Sequence
  source: /note="Description of Artificial Sequence: Synthetic peptide"
GAATRAT

SEQ ID NO: 864 - protein, 7 aa, Artificial Sequence
  source: /note="Description of Artificial Sequence: Synthetic peptide"
GASSRAT

SEQ ID NO: 865 - protein, 7 aa, Artificial Sequence
  source: /note="Description of Artificial Sequence: Synthetic peptide"
GASSRAT

SEQ ID NO: 866 - protein, 7 aa, Artificial Sequence
  source: /note="Description of Artificial Sequence: Synthetic peptide"
GASSRAT

SEQ ID NO: 867 - protein, 7 aa, Artificial Sequence
  source: /note="Description of Artificial Sequence: Synthetic peptide"
GASSRAT

SEQ ID NO: 868 - protein, 7 aa, Artificial Sequence
  source: /note="Description of Artificial Sequence: Synthetic peptide"
GASSRAT

SEQ ID NO: 869 - protein, 7 aa, Artificial Sequence
  source: /note="Description of Artificial Sequence: Synthetic peptide"
GASSRAT

SEQ ID NO: 870 - protein, 7 aa, Artificial Sequence
  source: /note="Description of Artificial Sequence: Synthetic peptide"
GASSRAT

SEQ ID NO: 871 - protein, 7 aa, Artificial Sequence
  source: /note="Description of Artificial Sequence: Synthetic peptide"
WASTRES

SEQ ID NO: 872 - protein, 7 aa, Artificial Sequence
  source: /note="Description of Artificial Sequence: Synthetic peptide"
WASTRES

SEQ ID NO: 873 - protein, 7 aa, Artificial Sequence
  source: /note="Description of Artificial Sequence: Synthetic peptide"
WASTRES

SEQ ID NO: 874 - protein, 7 aa, Artificial Sequence
  source: /note="Description of Artificial Sequence: Synthetic peptide"
WASTRES

SEQ ID NO: 875 - protein, 7 aa, Artificial Sequence
  source: /note="Description of Artificial Sequence: Synthetic peptide"
WASTRES

SEQ ID NO: 876 - protein, 7 aa, Artificial Sequence
  source: /note="Description of Artificial Sequence: Synthetic peptide"
WASTRES

SEQ ID NO: 877 - protein, 7 aa, Artificial Sequence
  source: /note="Description of Artificial Sequence: Synthetic peptide"
WASTRES

SEQ ID NO: 878 - protein, 7 aa, Artificial Sequence
  source: /note="Description of Artificial Sequence: Synthetic peptide"
WASTRES

SEQ ID NO: 879 - protein, 7 aa, Artificial Sequence
  source: /note="Description of Artificial Sequence: Synthetic peptide"
WASTRES

SEQ ID NO: 880 - protein, 7 aa, Artificial Sequence
  source: /note="Description of Artificial Sequence: Synthetic peptide"
WASTRES

SEQ ID NO: 881 - protein, 7 aa, Artificial Sequence
  source: /note="Description of Artificial Sequence: Synthetic peptide"
WASTRES

SEQ ID NO: 882 - protein, 7 aa, Artificial Sequence
  source: /note="Description of Artificial Sequence: Synthetic peptide"
WTSTRES

SEQ ID NO: 883 - protein, 7 aa, Artificial Sequence
  source: /note="Description of Artificial Sequence: Synthetic peptide"
WTSTRES

SEQ ID NO: 884 - protein, 7 aa, Artificial Sequence
  source: /note="Description of Artificial Sequence: Synthetic peptide"
WTSTRDS

SEQ ID NO: 885 - protein, 7 aa, Artificial Sequence
  source: /note="Description of Artificial Sequence: Synthetic peptide"
WTSTRES

SEQ ID NO: 886 - protein, 7 aa, Artificial Sequence
  source: /note="Description of Artificial Sequence: Synthetic peptide"
WTSTRES

SEQ ID NO: 887 - protein, 7 aa, Artificial Sequence
  source: /note="Description of Artificial Sequence: Synthetic peptide"
WTSTRDS

SEQ ID NO: 888 - protein, 7 aa, Artificial Sequence
  source: /note="Description of Artificial Sequence: Synthetic peptide"
WTSTRDS

SEQ ID NO: 889 - protein, 7 aa, Artificial Sequence
  source: /note="Description of Artificial Sequence: Synthetic peptide"
WTSTRES

SEQ ID NO: 890 - protein, 7 aa, Artificial Sequence
  source: /note="Description of Artificial Sequence: Synthetic peptide"
WTSTRES

SEQ ID NO: 891 - protein, 7 aa, Artificial Sequence
  source: /note="Description of Artificial Sequence: Synthetic peptide"
WASTRES

SEQ ID NO: 892 - protein, 7 aa, Artificial Sequence
  source: /note="Description of Artificial Sequence: Synthetic peptide"
WASTRES

SEQ ID NO: 893 - protein, 7 aa, Artificial Sequence
  source: /note="Description of Artificial Sequence: Synthetic peptide"
WASTRES

SEQ ID NO: 894 - protein, 7 aa, Artificial Sequence
  source: /note="Description of Artificial Sequence: Synthetic peptide"
WASTRES

SEQ ID NO: 895 - protein, 7 aa, Artificial Sequence
  source: /note="Description of Artificial Sequence: Synthetic peptide"
WASTRES

SEQ ID NO: 896 - protein, 7 aa, Artificial Sequence
  source: /note="Description of Artificial Sequence: Synthetic peptide"
WTSTRDS

SEQ ID NO: 897 - protein, 7 aa, Artificial Sequence
  source: /note="Description of Artificial Sequence: Synthetic peptide"
WTSTRDS

SEQ ID NO: 898 - protein, 7 aa, Artificial Sequence
  source: /note="Description of Artificial Sequence: Synthetic peptide"
WTSTRDS

SEQ ID NO: 899 - protein, 7 aa, Artificial Sequence
  source: /note="Description of Artificial Sequence: Synthetic peptide"
WTSTRDS

SEQ ID NO: 900 - protein, 7 aa, Artificial Sequence
  source: /note="Description of Artificial Sequence: Synthetic peptide"
WTSTRDS

SEQ ID NO: 901 - protein, 7 aa, Artificial Sequence
  source: /note="Description of Artificial Sequence: Synthetic peptide"
WTSTRDS

SEQ ID NO: 902 - protein, 7 aa, Artificial Sequence
  source: /note="Description of Artificial Sequence: Synthetic peptide"
WTSTRDS

SEQ ID NO: 903 - protein, 7 aa, Artificial Sequence
  source: /note="Description of Artificial Sequence: Synthetic peptide"
WTSTRES

SEQ ID NO: 904 - protein, 7 aa, Artificial Sequence
  source: /note="Description of Artificial Sequence: Synthetic peptide"
WTSTRES

SEQ ID NO: 905 - protein, 7 aa, Artificial Sequence
  source: /note="Description of Artificial Sequence: Synthetic peptide"
WTSTRES

SEQ ID NO: 906 - protein, 7 aa, Artificial Sequence
  source: /note="Description of Artificial Sequence: Synthetic peptide"
WTSTRES

SEQ ID NO: 907 - protein, 7 aa, Artificial Sequence
  source: /note="Description of Artificial Sequence: Synthetic peptide"
WTSTRDS

SEQ ID NO: 908 - protein, 7 aa, Artificial Sequence
  source: /note="Description of Artificial Sequence: Synthetic peptide"
WTSTRES

SEQ ID NO: 909 - protein, 7 aa, Artificial Sequence
  source: /note="Description of Artificial Sequence: Synthetic peptide"
TNNQRPS

SEQ ID NO: 910 - protein, 7 aa, Artificial Sequence
  source: /note="Description of Artificial Sequence: Synthetic peptide"
TNNQRPS

SEQ ID NO: 911 - protein, 7 aa, Artificial Sequence
  source: /note="Description of Artificial Sequence: Synthetic peptide"
TNNQRPS

SEQ ID NO: 912 - protein, 7 aa, Artificial Sequence
  source: /note="Description of Artificial Sequence: Synthetic peptide"
TNNQRPS

SEQ ID NO: 913 - protein, 7 aa, Artificial Sequence
  source: /note="Description of Artificial Sequence: Synthetic peptide"
TNNQRPS

SEQ ID NO: 914 - protein, 7 aa, Artificial Sequence
  source: /note="Description of Artificial Sequence: Synthetic peptide"
TNNQRPS

SEQ ID NO: 915 - protein, 7 aa, Artificial Sequence
  source: /note="Description of Artificial Sequence: Synthetic peptide"
TNNQRPS

SEQ ID NO: 916 - protein, 7 aa, Artificial Sequence
  source: /note="Description of Artificial Sequence: Synthetic peptide"
TNNQRPS

SEQ ID NO: 917 - protein, 7 aa, Artificial Sequence
  source: /note="Description of Artificial Sequence: Synthetic peptide"
TNNQRPS

SEQ ID NO: 918 - protein, 7 aa, Artificial Sequence
  source: /note="Description of Artificial Sequence: Synthetic peptide"
TNNQRPS

SEQ ID NO: 919 - protein, 7 aa, Artificial Sequence
  source: /note="Description of Artificial Sequence: Synthetic peptide"
TNNQRPS

SEQ ID NO: 920 - protein, 7 aa, Artificial Sequence
  source: /note="Description of Artificial Sequence: Synthetic peptide"
TNNQRPS

SEQ ID NO: 921 - protein, 7 aa, Artificial Sequence
  source: /note="Description of Artificial Sequence: Synthetic peptide"
TNNQRPS

SEQ ID NO: 922 - protein, 7 aa, Artificial Sequence
  source: /note="Description of Artificial Sequence: Synthetic peptide"
TNNQRPS

SEQ ID NO: 923 - protein, 7 aa, Artificial Sequence
  source: /note="Description of Artificial Sequence: Synthetic peptide"
GASSLQS

SEQ ID NO: 924 - protein, 7 aa, Artificial Sequence
  source: /note="Description of Artificial Sequence: Synthetic peptide"
GASSLQS

SEQ ID NO: 925 - protein, 7 aa, Artificial Sequence
  source: /note="Description of Artificial Sequence: Synthetic peptide"
TNNQRPS

SEQ ID NO: 926 - protein, 7 aa, Artificial Sequence
  source: /note="Description of Artificial Sequence: Synthetic peptide"
VASSLQS

SEQ ID NO: 927 - protein, 7 aa, Artificial Sequence
  source: /note="Description of Artificial Sequence: Synthetic peptide"
DNNKRPS

SEQ ID NO: 928 - protein, 7 aa, Artificial Sequence
  source: /note="Description of Artificial Sequence: Synthetic peptide"
VASSLQS

SEQ ID NO: 929 - protein, 7 aa, Artificial Sequence
  source: /note="Description of Artificial Sequence: Synthetic peptide"
VASSLQS

SEQ ID NO: 930 - protein, 7 aa, Artificial Sequence
  source: /note="Description of Artificial Sequence: Synthetic peptide"
VASSLQS

SEQ ID NO: 931 - protein, 7 aa, Artificial Sequence
  source: /note="Description of Artificial Sequence: Synthetic peptide"
VASSLQS

SEQ ID NO: 932 - protein, 7 aa, Artificial Sequence
  source: /note="Description of Artificial Sequence: Synthetic peptide"
VASSLQS

SEQ ID NO: 933 - protein, 7 aa, Artificial Sequence
  source: /note="Description of Artificial Sequence: Synthetic peptide"
VASSLQS

SEQ ID NO: 934 - protein, 7 aa, Artificial Sequence
  source: /note="Description of Artificial Sequence: Synthetic peptide"
DNNKRPS

SEQ ID NO: 935 - protein, 7 aa, Artificial Sequence
  source: /note="Description of Artificial Sequence: Synthetic peptide"
DNNKRPS

SEQ ID NO: 936 - protein, 7 aa, Artificial Sequence
  source: /note="Description of Artificial Sequence: Synthetic peptide"
DNNKRPS

SEQ ID NO: 937 - protein, 7 aa, Artificial Sequence
  source: /note="Description of Artificial Sequence: Synthetic peptide"
DNNKRPS

SEQ ID NO: 938 - protein, 7 aa, Artificial Sequence
  source: /note="Description of Artificial Sequence: Synthetic peptide"
DNNKRPS

SEQ ID NO: 939 - protein, 7 aa, Artificial Sequence
  source: /note="Description of Artificial Sequence: Synthetic peptide"
DNNKRPS

SEQ ID NO: 940 - protein, 7 aa, Artificial Sequence
  source: /note="Description of Artificial Sequence: Synthetic peptide"
DNNKRPS

SEQ ID NO: 941 - protein, 7 aa, Artificial Sequence
  source: /note="Description of Artificial Sequence: Synthetic peptide"
DNNKRPS

SEQ ID NO: 942 - protein, 7 aa, Artificial Sequence
  source: /note="Description of Artificial Sequence: Synthetic peptide"
VASSLQS

SEQ ID NO: 943 - protein, 11 aa, Artificial Sequence
  source: /note="Description of Artificial Sequence: Synthetic peptide"
ATFDDSLNGPV

SEQ ID NO: 944 - protein, 9 aa, Artificial Sequence
  source: /note="Description of Artificial Sequence: Synthetic peptide"
LQHNNYPFT

SEQ ID NO: 945 - protein, 9 aa, Artificial Sequence
  source: /note="Description of Artificial Sequence: Synthetic peptide"
LQHNNYPFT

SEQ ID NO: 946 - protein, 8 aa, Artificial Sequence
  source: /note="Description of Artificial Sequence: Synthetic peptide"
QQYDILLT

SEQ ID NO: 947 - protein, 9 aa, Artificial Sequence
  source: /note="Description of Artificial Sequence: Synthetic peptide"
QQYYSTPWT

SEQ ID NO: 948 - protein, 9 aa, Artificial Sequence
  source: /note="Description of Artificial Sequence: Synthetic peptide"
QQYYSTPWT

SEQ ID NO: 949 - protein, 9 aa, Artificial Sequence
  source: /note="Description of Artificial Sequence: Synthetic peptide"
QQYYRTPWT

SEQ ID NO: 950 - protein, 9 aa, Artificial Sequence
  source: /note="Description of Artificial Sequence: Synthetic peptide"
QQYYRTPWT

SEQ ID NO: 951 - protein, 9 aa, Artificial Sequence
  source: /note="Description of Artificial Sequence: Synthetic peptide"
QQYGSSPLT

SEQ ID NO: 952 - protein, 9 aa, Artificial Sequence
  source: /note="Description of Artificial Sequence: Synthetic peptide"
QQYNNWPLT

SEQ ID NO: 953 - protein, 9 aa, Artificial Sequence
  source: /note="Description of Artificial Sequence: Synthetic peptide"
LQHNSYPFT

SEQ ID NO: 954 - protein, 8 aa, Artificial Sequence
  source: /note="Description of Artificial Sequence: Synthetic peptide"
QQYDDLFT

SEQ ID NO: 955 - protein, 9 aa, Artificial Sequence
  source: /note="Description of Artificial Sequence: Synthetic peptide"
QQTNSFPPT

SEQ ID NO: 956 - protein, 9 aa, Artificial Sequence
  source: /note="Description of Artificial Sequence: Synthetic peptide"
QQTNSFPPT

SEQ ID NO: 957 - protein, 9 aa, Artificial Sequence
  source: /note="Description of Artificial Sequence: Synthetic peptide"
LQHNSYPFT

SEQ ID NO: 958 - protein, 9 aa, Artificial Sequence
  source: /note="Description of Artificial Sequence: Synthetic peptide"
LQHNSYPFT

SEQ ID NO: 959 - protein, 9 aa, Artificial Sequence
  source: /note="Description of Artificial Sequence: Synthetic peptide"
LQHNSYPFT

SEQ ID NO: 960 - protein, 9 aa, Artificial Sequence
  source: /note="Description of Artificial Sequence: Synthetic peptide"
LQHNSYPFT

SEQ ID NO: 961 - protein, 9 aa, Artificial Sequence
  source: /note="Description of Artificial Sequence: Synthetic peptide"
LQHNSYPFT

SEQ ID NO: 962 - protein, 9 aa, Artificial Sequence
  source: /note="Description of Artificial Sequence: Synthetic peptide"
LQHNSYPFT

SEQ ID NO: 963 - protein, 9 aa, Artificial Sequence
  source: /note="Description of Artificial Sequence: Synthetic peptide"
LQHNNYPFT

SEQ ID NO: 964 - protein, 9 aa, Artificial Sequence
  source: /note="Description of Artificial Sequence: Synthetic peptide"
LQHNNYPFT

SEQ ID NO: 965 - protein, 9 aa, Artificial Sequence
  source: /note="Description of Artificial Sequence: Synthetic peptide"
LQHNNYPFT

SEQ ID NO: 966 - protein, 9 aa, Artificial Sequence
  source: /note="Description of Artificial Sequence: Synthetic peptide"
LQHNNYPFT

SEQ ID NO: 967 - protein, 9 aa, Artificial Sequence
  source: /note="Description of Artificial Sequence: Synthetic peptide"
LQHNNYPFT

SEQ ID NO: 968 - protein, 9 aa, Artificial Sequence
  source: /note="Description of Artificial Sequence: Synthetic peptide"
LQHNNYPFT

SEQ ID NO: 969 - protein, 9 aa, Artificial Sequence
  source: /note="Description of Artificial Sequence: Synthetic peptide"
LQHNNYPFT

SEQ ID NO: 970 - protein, 9 aa, Artificial Sequence
  source: /note="Description of Artificial Sequence: Synthetic peptide"
LQHNNYPFT

SEQ ID NO: 971 - protein, 9 aa, Artificial Sequence
  source: /note="Description of Artificial Sequence: Synthetic peptide"
LQHNNYPFT

SEQ ID NO: 972 - protein, 9 aa, Artificial Sequence
  source: /note="Description of Artificial Sequence: Synthetic peptide"
LQHNNYPFT

SEQ ID NO: 973 - protein, 9 aa, Artificial Sequence
  source: /note="Description of Artificial Sequence: Synthetic peptide"
LQHNNYPFT

SEQ ID NO: 974 - protein, 9 aa, Artificial Sequence
  source: /note="Description of Artificial Sequence: Synthetic peptide"
LQHNNYPFT

SEQ ID NO: 975 - protein, 9 aa, Artificial Sequence
  source: /note="Description of Artificial Sequence: Synthetic peptide"
LQHNNYPFT

SEQ ID NO: 976 - protein, 9 aa, Artificial Sequence
  source: /note="Description of Artificial Sequence: Synthetic peptide"
LQHNNYPFT

SEQ ID NO: 977 - protein, 9 aa, Artificial Sequence
  source: /note="Description of Artificial Sequence: Synthetic peptide"
LQHNNYPFT

SEQ ID NO: 978 - protein, 9 aa, Artificial Sequence
  source: /note="Description of Artificial Sequence: Synthetic peptide"
LQHNNYPFT

SEQ ID NO: 979 - protein, 9 aa, Artificial Sequence
  source: /note="Description of Artificial Sequence: Synthetic peptide"
LQHNNYPFT

SEQ ID NO: 980 - protein, 9 aa, Artificial Sequence
  source: /note="Description of Artificial Sequence: Synthetic peptide"
LQHNNYPFT

SEQ ID NO: 981 - protein, 9 aa, Artificial Sequence
  source: /note="Description of Artificial Sequence: Synthetic peptide"
LQHNNYPFT

SEQ ID NO: 982 - protein, 8 aa, Artificial Sequence
  source: /note="Description of Artificial Sequence: Synthetic peptide"
QQYDILLT

SEQ ID NO: 983 - protein, 8 aa, Artificial Sequence
  source: /note="Description of Artificial Sequence: Synthetic peptide"
QQYDILLT

SEQ ID NO: 984 - protein, 8 aa, Artificial Sequence
  source: /note="Description of Artificial Sequence: Synthetic peptide"
QQYDILLT

SEQ ID NO: 985 - protein, 8 aa, Artificial Sequence
  source: /note="Description of Artificial Sequence: Synthetic peptide"
QQYDILLT

SEQ ID NO: 986 - protein, 8 aa, Artificial Sequence
  source: /note="Description of Artificial Sequence: Synthetic peptide"
QQYDILLT

SEQ ID NO: 987 - protein, 8 aa, Artificial Sequence
  source: /note="Description of Artificial Sequence: Synthetic peptide"
QQYDILLT

SEQ ID NO: 988 - protein, 8 aa, Artificial Sequence
  source: /note="Description of Artificial Sequence: Synthetic peptide"
QQYDILLT

SEQ ID NO: 989 - protein, 8 aa, Artificial Sequence
  source: /note="Description of Artificial Sequence: Synthetic peptide"
QQYDILLT

SEQ ID NO: 990 - protein, 8 aa, Artificial Sequence
  source: /note="Description of Artificial Sequence: Synthetic peptide"
QQYDILLT

SEQ ID NO: 991 - protein, 9 aa, Artificial Sequence
  source: /note="Description of Artificial Sequence: Synthetic peptide"
LQHNNYPFT

SEQ ID NO: 992 - protein, 9 aa, Artificial Sequence
  source: /note="Description of Artificial Sequence: Synthetic peptide"
LQHNNYPFT

SEQ ID NO: 993 - protein, 9 aa, Artificial Sequence
  source: /note="Description of Artificial Sequence: Synthetic peptide"
LQHNNYPFT

SEQ ID NO: 994 - protein, 9 aa, Artificial Sequence
  source: /note="Description of Artificial Sequence: Synthetic peptide"
LQHNNYPFT

SEQ ID NO: 995 - protein, 9 aa, Artificial Sequence
  source: /note="Description of Artificial Sequence: Synthetic peptide"
LQHNNYPFT

SEQ ID NO: 996 - protein, 9 aa, Artificial Sequence
  source: /note="Description of Artificial Sequence: Synthetic peptide"
LQHNNYPFT

SEQ ID NO: 997 - protein, 9 aa, Artificial Sequence
  source: /note="Description of Artificial Sequence: Synthetic peptide"
LQHNNYPFT

SEQ ID NO: 998 - protein, 8 aa, Artificial Sequence
  source: /note="Description of Artificial Sequence: Synthetic peptide"
QQYDDLFT

SEQ ID NO: 999 - protein, 8 aa, Artificial Sequence
  source: /note="Description of Artificial Sequence: Synthetic peptide"
QQYDDLFT

SEQ ID NO: 1000 - protein, 8 aa, Artificial Sequence
  source: /note="Description of Artificial Sequence: Synthetic peptide"
QQYDDLFT

SEQ ID NO: 1001 - protein, 8 aa, Artificial Sequence
  source: /note="Description of Artificial Sequence: Synthetic peptide"
QQYDDLFT

SEQ ID NO: 1002 - protein, 8 aa, Artificial Sequence
  source: /note="Description of Artificial Sequence: Synthetic peptide"
QQYDDLFT

SEQ ID NO: 1003 - protein, 8 aa, Artificial Sequence
  source: /note="Description of Artificial Sequence: Synthetic peptide"
QQYDDLFT

SEQ ID NO: 1004 - protein, 8 aa, Artificial Sequence
  source: /note="Description of Artificial Sequence: Synthetic peptide"
QQYDDLFT

SEQ ID NO: 1005 - protein, 8 aa, Artificial Sequence
  source: /note="Description of Artificial Sequence: Synthetic peptide"
QQYDDLFT

SEQ ID NO: 1006 - protein, 8 aa, Artificial Sequence
  source: /note="Description of Artificial Sequence: Synthetic peptide"
QQYDDLFT

SEQ ID NO: 1007 - protein, 8 aa, Artificial Sequence
  source: /note="Description of Artificial Sequence: Synthetic peptide"
QQYDDLFT

SEQ ID NO: 1008 - protein, 8 aa, Artificial Sequence
  source: /note="Description of Artificial Sequence: Synthetic peptide"
QQYDDLFT

SEQ ID NO: 1009 - protein, 8 aa, Artificial Sequence
  source: /note="Description of Artificial Sequence: Synthetic peptide"
QQYGSSPR

SEQ ID NO: 1010 - protein, 8 aa, Artificial Sequence
  source: /note="Description of Artificial Sequence: Synthetic peptide"
QQYGSSPR

SEQ ID NO: 1011 - protein, 8 aa, Artificial Sequence
  source: /note="Description of Artificial Sequence: Synthetic peptide"
QQYGSSPR

SEQ ID NO: 1012 - protein, 8 aa, Artificial Sequence
  source: /note="Description of Artificial Sequence: Synthetic peptide"
QQYGSSPR

SEQ ID NO: 1013 - protein, 9 aa, Artificial Sequence
  source: /note="Description of Artificial Sequence: Synthetic peptide"
QQYNNWPLT

SEQ ID NO: 1014 - protein, 9 aa, Artificial Sequence
  source: /note="Description of Artificial Sequence: Synthetic peptide"
QQYNNWPLT

SEQ ID NO: 1015 - protein, 9 aa, Artificial Sequence
  source: /note="Description of Artificial Sequence: Synthetic peptide"
QQYNNWPLT

SEQ ID NO: 1016 - protein, 9 aa, Artificial Sequence
  source: /note="Description of Artificial Sequence: Synthetic peptide"
QQYNNWPLT

SEQ ID NO: 1017 - protein, 9 aa, Artificial Sequence
  source: /note="Description of Artificial Sequence: Synthetic peptide"
QQYNNFPLT

SEQ ID NO: 1018 - protein, 9 aa, Artificial Sequence
  source: /note="Description of Artificial Sequence: Synthetic peptide"
QQYNNYPLT

SEQ ID NO: 1019 - protein, 9 aa, Artificial Sequence
  source: /note="Description of Artificial Sequence: Synthetic peptide"
QQYNNWPLT

SEQ ID NO: 1020 - protein, 9 aa, Artificial Sequence
  source: /note="Description of Artificial Sequence: Synthetic peptide"
QQYNNWPLT

SEQ ID NO: 1021 - protein, 9 aa, Artificial Sequence
  source: /note="Description of Artificial Sequence: Synthetic peptide"
QQYGSSPLT

SEQ ID NO: 1022 - protein, 9 aa, Artificial Sequence
  source: /note="Description of Artificial Sequence: Synthetic peptide"
QQYGSSPLT

SEQ ID NO: 1023 - protein, 9 aa, Artificial Sequence
  source: /note="Description of Artificial Sequence: Synthetic peptide"
QQYGSSPLT

SEQ ID NO: 1024 - protein, 9 aa, Artificial Sequence
  source: /note="Description of Artificial Sequence: Synthetic peptide"
QQYGSSPLT

SEQ ID NO: 1025 - protein, 9 aa, Artificial Sequence
  source: /note="Description of Artificial Sequence: Synthetic peptide"
QQYGSSPLT

SEQ ID NO: 1026 - protein, 9 aa, Artificial Sequence
  source: /note="Description of Artificial Sequence: Synthetic peptide"
QQYGSSPLT

SEQ ID NO: 1027 - protein, 9 aa, Artificial Sequence
  source: /note="Description of Artificial Sequence: Synthetic peptide"
QQYGSSPLT

SEQ ID NO: 1028 - protein, 9 aa, Artificial Sequence
  source: /note="Description of Artificial Sequence: Synthetic peptide"
QQYYSTPWT

SEQ ID NO: 1029 - protein, 9 aa, Artificial Sequence
  source: /note="Description of Artificial Sequence: Synthetic peptide"
QQYYSTPWT

SEQ ID NO: 1030 - protein, 9 aa, Artificial Sequence
  source: /note="Description of Artificial Sequence: Synthetic peptide"
QQYYSTPWT

SEQ ID NO: 1031 - protein, 9 aa, Artificial Sequence
  source: /note="Description of Artificial Sequence: Synthetic peptide"
QQYYSTPWT

SEQ ID NO: 1032 - protein, 9 aa, Artificial Sequence
  source: /note="Description of Artificial Sequence: Synthetic peptide"
QQYYSTPWT

SEQ ID NO: 1033 - protein, 9 aa, Artificial Sequence
  source: /note="Description of Artificial Sequence: Synthetic peptide"
QQYYSTPWT

SEQ ID NO: 1034 - protein, 9 aa, Artificial Sequence
  source: /note="Description of Artificial Sequence: Synthetic peptide"
QQYYSTPWT

SEQ ID NO: 1035 - protein, 9 aa, Artificial Sequence
  source: /note="Description of Artificial Sequence: Synthetic peptide"
QQYYSTPWT

SEQ ID NO: 1036 - protein, 9 aa, Artificial Sequence
  source: /note="Description of Artificial Sequence: Synthetic peptide"
QQYYSTPWT

SEQ ID NO: 1037 - protein, 9 aa, Artificial Sequence
  source: /note="Description of Artificial Sequence: Synthetic peptide"
QQYYSTPWT

SEQ ID NO: 1038 - protein, 9 aa, Artificial Sequence
  source: /note="Description of Artificial Sequence: Synthetic peptide"
QQYYSTPWT

SEQ ID NO: 1039 - protein, 9 aa, Artificial Sequence
  source: /note="Description of Artificial Sequence: Synthetic peptide"
QQYYRTPWT

SEQ ID NO: 1040 - protein, 9 aa, Artificial Sequence
  source: /note="Description of Artificial Sequence: Synthetic peptide"
QQYYRTPWT

SEQ ID NO: 1041 - protein, 9 aa, Artificial Sequence
  source: /note="Description of Artificial Sequence: Synthetic peptide"
QQYYRTPWT

SEQ ID NO: 1042 - protein, 9 aa, Artificial Sequence
  source: /note="Description of Artificial Sequence: Synthetic peptide"
QQYYRTPWT

SEQ ID NO: 1043 - protein, 9 aa, Artificial Sequence
  source: /note="Description of Artificial Sequence: Synthetic peptide"
QQYYRTPWT

SEQ ID NO: 1044 - protein, 9 aa, Artificial Sequence
  source: /note="Description of Artificial Sequence: Synthetic peptide"
QQYYRTPWT

SEQ ID NO: 1045 - protein, 9 aa, Artificial Sequence
  source: /note="Description of Artificial Sequence: Synthetic peptide"
QQYYRTPWT

SEQ ID NO: 1046 - protein, 9 aa, Artificial Sequence
  source: /note="Description of Artificial Sequence: Synthetic peptide"
QQYYRTPWT

SEQ ID NO: 1047 - protein, 9 aa, Artificial Sequence
  source: /note="Description of Artificial Sequence: Synthetic peptide"
QQYYRTPWT

SEQ ID NO: 1048 - protein, 9 aa, Artificial Sequence
  source: /note="Description of Artificial Sequence: Synthetic peptide"
QQYYSTPWT

SEQ ID NO: 1049 - protein, 9 aa, Artificial Sequence
  source: /note="Description of Artificial Sequence: Synthetic peptide"
QQYYSTPWT

SEQ ID NO: 1050 - protein, 9 aa, Artificial Sequence
  source: /note="Description of Artificial Sequence: Synthetic peptide"
QQYYSTPWT

SEQ ID NO: 1051 - protein, 9 aa, Artificial Sequence
  source: /note="Description of Artificial Sequence: Synthetic peptide"
QQYYSTPWT

SEQ ID NO: 1052 - protein, 9 aa, Artificial Sequence
  source: /note="Description of Artificial Sequence: Synthetic peptide"
QQYYSTPWT

SEQ ID NO: 1053 - protein, 9 aa, Artificial Sequence
  source: /note="Description of Artificial Sequence: Synthetic peptide"
QQYYRTPWT

SEQ ID NO: 1054 - protein, 9 aa, Artificial Sequence
  source: /note="Description of Artificial Sequence: Synthetic peptide"
QQYYRTPWT

SEQ ID NO: 1055 - protein, 9 aa, Artificial Sequence
  source: /note="Description of Artificial Sequence: Synthetic peptide"
QQYYRTPWT

SEQ ID NO: 1056 - protein, 9 aa, Artificial Sequence
  source: /note="Description of Artificial Sequence: Synthetic peptide"
QQYYRTPWT

SEQ ID NO: 1057 - protein, 9 aa, Artificial Sequence
  source: /note="Description of Artificial Sequence: Synthetic peptide"
QQYYRTPWT

SEQ ID NO: 1058 - protein, 9 aa, Artificial Sequence
  source: /note="Description of Artificial Sequence: Synthetic peptide"
QQYYRTPWT

SEQ ID NO: 1059 - protein, 9 aa, Artificial Sequence
  source: /note="Description of Artificial Sequence: Synthetic peptide"
QQYYRTPWT

SEQ ID NO: 1060 - protein, 9 aa, Artificial Sequence
  source: /note="Description of Artificial Sequence: Synthetic peptide"
QQYYRTPWT

SEQ ID NO: 1061 - protein, 9 aa, Artificial Sequence
  source: /note="Description of Artificial Sequence: Synthetic peptide"
QQYYRTPWT

SEQ ID NO: 1062 - protein, 9 aa, Artificial Sequence
  source: /note="Description of Artificial Sequence: Synthetic peptide"
QQYYRTPWT

SEQ ID NO: 1063 - protein, 9 aa, Artificial Sequence
  source: /note="Description of Artificial Sequence: Synthetic peptide"
QQYYRTPWT

SEQ ID NO: 1064 - protein, 9 aa, Artificial Sequence
  source: /note="Description of Artificial Sequence: Synthetic peptide"
QQYYRTPWT

SEQ ID NO: 1065 - protein, 9 aa, Artificial Sequence
  source: /note="Description of Artificial Sequence: Synthetic peptide"
QQYYRTPWT

SEQ ID NO: 1066 - protein, 11 aa, Artificial Sequence
  source: /note="Description of Artificial Sequence: Synthetic peptide"
ATFDESLSGPV

SEQ ID NO: 1067 - protein, 11 aa, Artificial Sequence
  source: /note="Description of Artificial Sequence: Synthetic peptide"
ATFDESLQGPV

SEQ ID NO: 1068 - protein, 11 aa, Artificial Sequence
  source: /note="Description of Artificial Sequence: Synthetic peptide"
ATFDESLSGPV

SEQ ID NO: 1069 - protein, 11 aa, Artificial Sequence
  source: /note="Description of Artificial Sequence: Synthetic peptide"
ATFDESLQGPV

SEQ ID NO: 1070 - protein, 11 aa, Artificial Sequence
  source: /note="Description of Artificial Sequence: Synthetic peptide"
ATFDDSLNGPV

SEQ ID NO: 1071 - protein, 11 aa, Artificial Sequence
  source: /note="Description of Artificial Sequence: Synthetic peptide"
ATFDDSLNGPV

SEQ ID NO: 1072 - protein, 11 aa, Artificial Sequence
  source: /note="Description of Artificial Sequence: Synthetic peptide"
ATFDESLNGPV

SEQ ID NO: 1073 - protein, 11 aa, Artificial Sequence
  source: /note="Description of Artificial Sequence: Synthetic peptide"
ATFDDSLQGPV

SEQ ID NO: 1074 - protein, 11 aa, Artificial Sequence
  source: /note="Description of Artificial Sequence: Synthetic peptide"
ATFDDSLSGPV

SEQ ID NO: 1075 - protein, 11 aa, Artificial Sequence
  source: /note="Description of Artificial Sequence: Synthetic peptide"
ATFDDSLNAPV

SEQ ID NO: 1076 - protein, 11 aa, Artificial Sequence
  source: /note="Description of Artificial Sequence: Synthetic peptide"
ATFDSSLNGPV

SEQ ID NO: 1077 - protein, 11 aa, Artificial Sequence
  source: /note="Description of Artificial Sequence: Synthetic peptide"
ATFDSSLNAPV

SEQ ID NO: 1078 - protein, 11 aa, Artificial Sequence
  source: /note="Description of Artificial Sequence: Synthetic peptide"
ATFDSSLNAPV

SEQ ID NO: 1079 - protein, 11 aa, Artificial Sequence
  source: /note="Description of Artificial Sequence: Synthetic peptide"
ATFDESLSGPV

SEQ ID NO: 1080 - protein, 9 aa, Artificial Sequence
  source: /note="Description of Artificial Sequence: Synthetic peptide"
LQHNNYPFT

SEQ ID NO: 1081 - protein, 9 aa, Artificial Sequence
  source: /note="Description of Artificial Sequence: Synthetic peptide"
LQHNNYPFT

SEQ ID NO: 1082 - protein, 11 aa, Artificial Sequence
  source: /note="Description of Artificial Sequence: Synthetic peptide"
ATFDSSLSGPV

SEQ ID NO: 1083 - protein, 9 aa, Artificial Sequence
  source: /note="Description of Artificial Sequence: Synthetic peptide"
QQSYSTLIS

SEQ ID NO: 1084 - protein, 11 aa, Artificial Sequence
  source: /note="Description of Artificial Sequence: Synthetic peptide"
GTWDSSLSAVV

SEQ ID NO: 1085 - protein, 9 aa, Artificial Sequence
  source: /note="Description of Artificial Sequence: Synthetic peptide"
QQSYSTLIS

SEQ ID NO: 1086 - protein, 9 aa, Artificial Sequence
  source: /note="Description of Artificial Sequence: Synthetic peptide"
QQSYSTLIS

SEQ ID NO: 1087 - protein, 9 aa, Artificial Sequence
  source: /note="Description of Artificial Sequence: Synthetic peptide"
QQSYSTLIS

SEQ ID NO: 1088 - protein, 9 aa, Artificial Sequence
  source: /note="Description of Artificial Sequence: Synthetic peptide"
QQSYSTLIS

SEQ ID NO: 1089 - protein, 9 aa, Artificial Sequence
  source: /note="Description of Artificial Sequence: Synthetic peptide"
QQSYSTLIS

SEQ ID NO: 1090 - protein, 9 aa, Artificial Sequence
  source: /note="Description of Artificial Sequence: Synthetic peptide"
QQSYSTLIS

SEQ ID NO: 1091 - protein, 11 aa, Artificial Sequence
  source: /note="Description of Artificial Sequence: Synthetic peptide"
GTWDSSLSAVV

SEQ ID NO: 1092 - protein, 11 aa, Artificial Sequence
  source: /note="Description of Artificial Sequence: Synthetic peptide"
GTWDSSLSAVV

SEQ ID NO: 1093 - protein, 11 aa, Artificial Sequence
  source: /note="Description of Artificial Sequence: Synthetic peptide"
GTWDSSLSAVV

SEQ ID NO: 1094 - protein, 11 aa, Artificial Sequence
  source: /note="Description of Artificial Sequence: Synthetic peptide"
GTFESSLSAVV

SEQ ID NO: 1095 - protein, 11 aa, Artificial Sequence
  source: /note="Description of Artificial Sequence: Synthetic peptide"
GTWDSSLSAVV

SEQ ID NO: 1096 - protein, 11 aa, Artificial Sequence
  source: /note="Description of Artificial Sequence: Synthetic peptide"
GTWDSSLSAVV

SEQ ID NO: 1097 - protein, 11 aa, Artificial Sequence
  source: /note="Description of Artificial Sequence: Synthetic peptide"
GTWDSSLSAVV

SEQ ID NO: 1098 - protein, 11 aa, Artificial Sequence
  source: /note="Description of Artificial Sequence: Synthetic peptide"
GTFESSLSAVV

SEQ ID NO: 1099 - protein, 9 aa, Artificial Sequence
  source: /note="Description of Artificial Sequence: Synthetic peptide"
QQSYSTLLS

SEQ ID NO: 1100 - protein, 5 aa, Artificial Sequence
  source: /note="Description of Artificial Sequence: Synthetic peptide"
GYYMH

SEQ ID NO: 1101 - protein, 5 aa, Artificial Sequence
  source: /note="Description of Artificial Sequence: Synthetic peptide"
NFGMH

SEQ ID NO: 1102 - protein, 5 aa, Artificial Sequence
  source: /note="Description of Artificial Sequence: Synthetic peptide"
YFGMH

SEQ ID NO: 1103 - protein, 5 aa, Artificial Sequence
  source: /note="Description of Artificial Sequence: Synthetic peptide"
SYGMH

SEQ ID NO: 1104 - protein, 5 aa, Artificial Sequence
  source: /note="Description of Artificial Sequence: Synthetic peptide"
GYYIH

SEQ ID NO: 1105 - protein, 5 aa, Artificial Sequence
  source: /note="Description of Artificial Sequence: Synthetic peptide"
GYYIH

SEQ ID NO: 1106 - protein, 5 aa, Artificial Sequence
  source: /note="Description of Artificial Sequence: Synthetic peptide"
GYYIH

SEQ ID NO: 1107 - protein, 5 aa, Artificial Sequence
  source: /note="Description of Artificial Sequence: Synthetic peptide"
GYYIH

SEQ ID NO: 1108 - protein, 7 aa, Artificial Sequence
  source: /note="Description of Artificial Sequence: Synthetic peptide"
SGGYYWS

SEQ ID NO: 1109 - protein, 5 aa, Artificial Sequence
  source: /note="Description of Artificial Sequence: Synthetic peptide"
NYGMH

SEQ ID NO: 1110 - protein, 5 aa, Artificial Sequence
  source: /note="Description of Artificial Sequence: Synthetic peptide"
YFGMH

SEQ ID NO: 1111 - protein, 5 aa, Artificial Sequence
  source: /note="Description of Artificial Sequence: Synthetic peptide"
SYGMH

SEQ ID NO: 1112 - protein, 5 aa, Artificial Sequence
  source: /note="Description of Artificial Sequence: Synthetic peptide"
SYYWS

SEQ ID NO: 1113 - protein, 5 aa, Artificial Sequence
  source: /note="Description of Artificial Sequence: Synthetic peptide"
SYYWS

SEQ ID NO: 1114 - protein, 5 aa, Artificial Sequence
  source: /note="Description of Artificial Sequence: Synthetic peptide"
YFGMH

SEQ ID NO: 1115 - protein, 5 aa, Artificial Sequence
  source: /note="Description of Artificial Sequence: Synthetic peptide"
YFGMH

SEQ ID NO: 1116 - protein, 5 aa, Artificial Sequence
  source: /note="Description of Artificial Sequence: Synthetic peptide"
YFGMH

SEQ ID NO: 1117 - protein, 5 aa, Artificial Sequence
  source: /note="Description of Artificial Sequence: Synthetic peptide"
YFGMH

SEQ ID NO: 1118 - protein, 5 aa, Artificial Sequence
  source: /note="Description of Artificial Sequence: Synthetic peptide"
YFGMH

SEQ ID NO: 1119 - protein, 5 aa, Artificial Sequence
  source: /note="Description of Artificial Sequence: Synthetic peptide"
YFGMH

SEQ ID NO: 1120 - protein, 5 aa, Artificial Sequence
  source: /note="Description of Artificial Sequence: Synthetic peptide"
NFGMH

SEQ ID NO: 1121 - protein, 5 aa, Artificial Sequence
  source: /note="Description of Artificial Sequence: Synthetic peptide"
NFGMH

SEQ ID NO: 1122 - protein, 5 aa, Artificial Sequence
  source: /note="Description of Artificial Sequence: Synthetic peptide"
NFGMH

SEQ ID NO: 1123 - protein, 5 aa, Artificial Sequence
  source: /note="Description of Artificial Sequence: Synthetic peptide"
NFGMH

SEQ ID NO: 1124 - protein, 5 aa, Artificial Sequence
  source: /note="Description of Artificial Sequence: Synthetic peptide"
NFGMH

SEQ ID NO: 1125 - protein, 5 aa, Artificial Sequence
  source: /note="Description of Artificial Sequence: Synthetic peptide"
NFGMH

SEQ ID NO: 1126 - protein, 5 aa, Artificial Sequence
  source: /note="Description of Artificial Sequence: Synthetic peptide"
NFGMH

SEQ ID NO: 1127 - protein, 5 aa, Artificial Sequence
  source: /note="Description of Artificial Sequence: Synthetic peptide"
NFGMH

SEQ ID NO: 1128 - protein, 5 aa, Artificial Sequence
  source: /note="Description of Artificial Sequence: Synthetic peptide"
NFGMH

SEQ ID NO: 1129 - protein, 5 aa, Artificial Sequence
  source: /note="Description of Artificial Sequence: Synthetic peptide"
NFGMH

SEQ ID NO: 1130 - protein, 5 aa, Artificial Sequence
  source: /note="Description of Artificial Sequence: Synthetic peptide"
NFGMH

SEQ ID NO: 1131 - protein, 5 aa, Artificial Sequence
  source: /note="Description of Artificial Sequence: Synthetic peptide"
NFGMH

SEQ ID NO: 1132 - protein, 5 aa, Artificial Sequence
  source: /note="Description of Artificial Sequence: Synthetic peptide"
NFGMH

SEQ ID NO: 1133 - protein, 5 aa, Artificial Sequence
  source: /note="Description of Artificial Sequence: Synthetic peptide"
NFGMH

SEQ ID NO: 1134 - protein, 5 aa, Artificial Sequence
  source: /note="Description of Artificial Sequence: Synthetic peptide"
NFGMH

SEQ ID NO: 1135 - protein, 5 aa, Artificial Sequence
  source: /note="Description of Artificial Sequence: Synthetic peptide"
NFGMH

SEQ ID NO: 1136 - protein, 5 aa, Artificial Sequence
  source: /note="Description of Artificial Sequence: Synthetic peptide"
NFGMH

SEQ ID NO: 1137 - protein, 5 aa, Artificial Sequence
  source: /note="Description of Artificial Sequence: Synthetic peptide"
NFGMH

SEQ ID NO: 1138 - protein, 5 aa, Artificial Sequence
  source: /note="Description of Artificial Sequence: Synthetic peptide"
NFGMH

SEQ ID NO: 1139 - protein, 5 aa, Artificial Sequence
  source: /note="Description of Artificial Sequence: Synthetic peptide"
SYGMH

SEQ ID NO: 1140 - protein, 5 aa, Artificial Sequence
  source: /note="Description of Artificial Sequence: Synthetic peptide"
SYGMH

SEQ ID NO: 1141 - protein, 5 aa, Artificial Sequence
  source: /note="Description of Artificial Sequence: Synthetic peptide"
SYGMH

SEQ ID NO: 1142 - protein, 5 aa, Artificial Sequence
  source: /note="Description of Artificial Sequence: Synthetic peptide"
SYGMH

SEQ ID NO: 1143 - protein, 5 aa, Artificial Sequence
  source: /note="Description of Artificial Sequence: Synthetic peptide"
SYGMH

SEQ ID NO: 1144 - protein, 5 aa, Artificial Sequence
  source: /note="Description of Artificial Sequence: Synthetic peptide"
SYGMH

SEQ ID NO: 1145 - protein, 5 aa, Artificial Sequence
  source: /note="Description of Artificial Sequence: Synthetic peptide"
SYGMH

SEQ ID NO: 1146 - protein, 5 aa, Artificial Sequence
  source: /note="Description of Artificial Sequence: Synthetic peptide"
SYGMH

SEQ ID NO: 1147 - protein, 5 aa, Artificial Sequence
  source: /note="Description of Artificial Sequence: Synthetic peptide"
SYGMH

SEQ ID NO: 1148 - protein, 5 aa, Artificial Sequence
  source: /note="Description of Artificial Sequence: Synthetic peptide"
YFGMH

SEQ ID NO: 1149 - protein, 5 aa, Artificial Sequence
  source: /note="Description of Artificial Sequence: Synthetic peptide"
YFGMH

SEQ ID NO: 1150 - protein, 5 aa, Artificial Sequence
  source: /note="Description of Artificial Sequence: Synthetic peptide"
YFGMH

SEQ ID NO: 1151 - protein, 5 aa, Artificial Sequence
  source: /note="Description of Artificial Sequence: Synthetic peptide"
YFGMH

SEQ ID NO: 1152 - protein, 5 aa, Artificial Sequence
  source: /note="Description of Artificial Sequence: Synthetic peptide"
YFGMH

SEQ ID NO: 1153 - protein, 5 aa, Artificial Sequence
  source: /note="Description of Artificial Sequence: Synthetic peptide"
YFGMH

SEQ ID NO: 1154 - protein, 5 aa, Artificial Sequence
  source: /note="Description of Artificial Sequence: Synthetic peptide"
YFGMH

SEQ ID NO: 1155 - protein, 5 aa, Artificial Sequence
  source: /note="Description of Artificial Sequence: Synthetic peptide"
SYGMH

SEQ ID NO: 1156 - protein, 5 aa, Artificial Sequence
  source: /note="Description of Artificial Sequence: Synthetic peptide"
SYGMH

SEQ ID NO: 1157 - protein, 5 aa, Artificial Sequence
  source: /note="Description of Artificial Sequence: Synthetic peptide"
SYGMH

SEQ ID NO: 1158 - protein, 5 aa, Artificial Sequence
  source: /note="Description of Artificial Sequence: Synthetic peptide"
SYGMH

SEQ ID NO: 1159 - protein, 5 aa, Artificial Sequence
  source: /note="Description of Artificial Sequence: Synthetic peptide"
SYGMH

SEQ ID NO: 1160 - protein, 5 aa, Artificial Sequence
  source: /note="Description of Artificial Sequence: Synthetic peptide"
SYGMH

SEQ ID NO: 1161 - protein, 5 aa, Artificial Sequence
  source: /note="Description of Artificial Sequence: Synthetic peptide"
SYGMH

SEQ ID NO: 1162 - protein, 5 aa, Artificial Sequence
  source: /note="Description of Artificial Sequence: Synthetic peptide"
SYGMH

SEQ ID NO: 1163 - protein, 5 aa, Artificial Sequence
  source: /note="Description of Artificial Sequence: Synthetic peptide"
SYGMH

SEQ ID NO: 1164 - protein, 5 aa, Artificial Sequence
  source: /note="Description of Artificial Sequence: Synthetic peptide"
SYGMH

SEQ ID NO: 1165 - protein, 5 aa, Artificial Sequence
  source: /note="Description of Artificial Sequence: Synthetic peptide"
SYGMH

SEQ ID NO: 1166 - protein, 5 aa, Artificial Sequence
  source: /note="Description of Artificial Sequence: Synthetic peptide"
SYGMH

SEQ ID NO: 1167 - protein, 5 aa, Artificial Sequence
  source: /note="Description of Artificial Sequence: Synthetic peptide"
SYGMH

SEQ ID NO: 1168 - protein, 5 aa, Artificial Sequence
  source: /note="Description of Artificial Sequence: Synthetic peptide"
SYGMH

SEQ ID NO: 1169 - protein, 5 aa, Artificial Sequence
  source: /note="Description of Artificial Sequence: Synthetic peptide"
SYGMH

SEQ ID NO: 1170 - protein, 5 aa, Artificial Sequence
  source: /note="Description of Artificial Sequence: Synthetic peptide"
NYGMH

SEQ ID NO: 1171 - protein, 5 aa, Artificial Sequence
  source: /note="Description of Artificial Sequence: Synthetic peptide"
NYGMH

SEQ ID NO: 1172 - protein, 5 aa, Artificial Sequence
  source: /note="Description of Artificial Sequence: Synthetic peptide"
NYGMH

SEQ ID NO: 1173 - protein, 5 aa, Artificial Sequence
  source: /note="Description of Artificial Sequence: Synthetic peptide"
NYGMH

SEQ ID NO: 1174 - protein, 5 aa, Artificial Sequence
  source: /note="Description of Artificial Sequence: Synthetic peptide"
NYGMH

SEQ ID NO: 1175 - protein, 5 aa, Artificial Sequence
  source: /note="Description of Artificial Sequence: Synthetic peptide"
NYGMH

SEQ ID NO: 1176 - protein, 5 aa, Artificial Sequence
  source: /note="Description of Artificial Sequence: Synthetic peptide"
NYGMH

SEQ ID NO: 1177 - protein, 5 aa, Artificial Sequence
  source: /note="Description of Artificial Sequence: Synthetic peptide"
NYGMH

SEQ ID NO: 1178 - protein, 7 aa, Artificial Sequence
  source: /note="Description of Artificial Sequence: Synthetic peptide"
SGGYYWS

SEQ ID NO: 1179 - protein, 7 aa, Artificial Sequence
  source: /note="Description of Artificial Sequence: Synthetic peptide"
SGGYYWS

SEQ ID NO: 1180 - protein, 7 aa, Artificial Sequence
  source: /note="Description of Artificial Sequence: Synthetic peptide"
SGGYYWS

SEQ ID NO: 1181 - protein, 7 aa, Artificial Sequence
  source: /note="Description of Artificial Sequence: Synthetic peptide"
SGGYYWS

SEQ ID NO: 1182 - protein, 7 aa, Artificial Sequence
  source: /note="Description of Artificial Sequence: Synthetic peptide"
SGGYYWS

SEQ ID NO: 1183 - protein, 7 aa, Artificial Sequence
  source: /note="Description of Artificial Sequence: Synthetic peptide"
SGGYYWS

SEQ ID NO: 1184 - protein, 7 aa, Artificial Sequence
  source: /note="Description of Artificial Sequence: Synthetic peptide"
SGGYYWS

SEQ ID NO: 1185 - protein, 5 aa, Artificial Sequence
  source: /note="Description of Artificial Sequence: Synthetic peptide"
GYYIH

SEQ ID NO: 1186 - protein, 5 aa, Artificial Sequence
  source: /note="Description of Artificial Sequence: Synthetic peptide"
GYYIH

SEQ ID NO: 1187 - protein, 5 aa, Artificial Sequence
  source: /note="Description of Artificial Sequence: Synthetic peptide"
GYYIH

SEQ ID NO: 1188 - protein, 5 aa, Artificial Sequence
  source: /note="Description of Artificial Sequence: Synthetic peptide"
GYYIH

SEQ ID NO: 1189 - protein, 5 aa, Artificial Sequence
  source: /note="Description of Artificial Sequence: Synthetic peptide"
GYYIH

SEQ ID NO: 1190 - protein, 5 aa, Artificial Sequence
  source: /note="Description of Artificial Sequence: Synthetic peptide"
GYYIH

SEQ ID NO: 1191 - protein, 5 aa, Artificial Sequence
  source: /note="Description of Artificial Sequence: Synthetic peptide"
GYYIH

SEQ ID NO: 1192 - protein, 5 aa, Artificial Sequence
  source: /note="Description of Artificial Sequence: Synthetic peptide"
GYYIH

SEQ ID NO: 1193 - protein, 5 aa, Artificial Sequence
  source: /note="Description of Artificial Sequence: Synthetic peptide"
GYYIH

SEQ ID NO: 1194 - protein, 5 aa, Artificial Sequence
  source: /note="Description of Artificial Sequence: Synthetic peptide"
GYYIH

SEQ ID NO: 1195 - protein, 5 aa, Artificial Sequence
  source: /note="Description of Artificial Sequence: Synthetic peptide"
GYYIH

SEQ ID NO: 1196 - protein, 5 aa, Artificial Sequence
  source: /note="Description of Artificial Sequence: Synthetic peptide"
GYYIH

SEQ ID NO: 1197 - protein, 5 aa, Artificial Sequence
  source: /note="Description of Artificial Sequence: Synthetic peptide"
GYYIH

SEQ ID NO: 1198 - protein, 5 aa, Artificial Sequence
  source: /note="Description of Artificial Sequence: Synthetic peptide"
GYYIH

SEQ ID NO: 1199 - protein, 5 aa, Artificial Sequence
  source: /note="Description of Artificial Sequence: Synthetic peptide"
GYYIH

SEQ ID NO: 1200 - protein, 5 aa, Artificial Sequence
  source: /note="Description of Artificial Sequence: Synthetic peptide"
GYYIH

SEQ ID NO: 1201 - protein, 5 aa, Artificial Sequence
  source: /note="Description of Artificial Sequence: Synthetic peptide"
GYYIH

SEQ ID NO: 1202 - protein, 5 aa, Artificial Sequence
  source: /note="Description of Artificial Sequence: Synthetic peptide"
GYYIH

SEQ ID NO: 1203 - protein, 5 aa, Artificial Sequence
  source: /note="Description of Artificial Sequence: Synthetic peptide"
GYYIH

SEQ ID NO: 1204 - protein, 5 aa, Artificial Sequence
  source: /note="Description of Artificial Sequence: Synthetic peptide"
GYYIH

SEQ ID NO: 1205 - protein, 5 aa, Artificial Sequence
  source: /note="Description of Artificial Sequence: Synthetic peptide"
GYYIH

SEQ ID NO: 1206 - protein, 5 aa, Artificial Sequence
  source: /note="Description of Artificial Sequence: Synthetic peptide"
GYYIH

SEQ ID NO: 1207 - protein, 5 aa, Artificial Sequence
  source: /note="Description of Artificial Sequence: Synthetic peptide"
GYYIH

SEQ ID NO: 1208 - protein, 5 aa, Artificial Sequence
  source: /note="Description of Artificial Sequence: Synthetic peptide"
GYYIH

SEQ ID NO: 1209 - protein, 5 aa, Artificial Sequence
  source: /note="Description of Artificial Sequence: Synthetic peptide"
GYYIH

SEQ ID NO: 1210 - protein, 5 aa, Artificial Sequence
  source: /note="Description of Artificial Sequence: Synthetic peptide"
GYYIH

SEQ ID NO: 1211 - protein, 5 aa, Artificial Sequence
  source: /note="Description of Artificial Sequence: Synthetic peptide"
GYYIH

SEQ ID NO: 1212 - protein, 5 aa, Artificial Sequence
  source: /note="Description of Artificial Sequence: Synthetic peptide"
GYYIH

SEQ ID NO: 1213 - protein, 5 aa, Artificial Sequence
  source: /note="Description of Artificial Sequence: Synthetic peptide"
GYYIH

SEQ ID NO: 1214 - protein, 5 aa, Artificial Sequence
  source: /note="Description of Artificial Sequence: Synthetic peptide"
GYYIH

SEQ ID NO: 1215 - protein, 5 aa, Artificial Sequence
  source: /note="Description of Artificial Sequence: Synthetic peptide"
GYYIH

SEQ ID NO: 1216 - protein, 5 aa, Artificial Sequence
  source: /note="Description of Artificial Sequence: Synthetic peptide"
GYYIH

SEQ ID NO: 1217 - protein, 5 aa, Artificial Sequence
  source: /note="Description of Artificial Sequence: Synthetic peptide"
GYYIH

SEQ ID NO: 1218 - protein, 5 aa, Artificial Sequence
  source: /note="Description of Artificial Sequence: Synthetic peptide"
GYYIH

SEQ ID NO: 1219 - protein, 5 aa, Artificial Sequence
  source: /note="Description of Artificial Sequence: Synthetic peptide"
GYYIH

SEQ ID NO: 1220 - protein, 5 aa, Artificial Sequence
  source: /note="Description of Artificial Sequence: Synthetic peptide"
GYYIH

SEQ ID NO: 1221 - protein, 5 aa, Artificial Sequence
  source: /note="Description of Artificial Sequence: Synthetic peptide"
GYYIH

SEQ ID NO: 1222 - protein, 5 aa, Artificial Sequence
  source: /note="Description of Artificial Sequence: Synthetic peptide"
GYYIH

SEQ ID NO: 1223 - protein, 5 aa, Artificial Sequence
  source: /note="Description of Artificial Sequence: Synthetic peptide"
GYYMH

SEQ ID NO: 1224 - protein, 5 aa, Artificial Sequence
  source: /note="Description of Artificial Sequence: Synthetic peptide"
GYYMH

SEQ ID NO: 1225 - protein, 5 aa, Artificial Sequence
  source: /note="Description of Artificial Sequence: Synthetic peptide"
GYYMH

SEQ ID NO: 1226 - protein, 5 aa, Artificial Sequence
  source: /note="Description of Artificial Sequence: Synthetic peptide"
GYYMH

SEQ ID NO: 1227 - protein, 5 aa, Artificial Sequence
  source: /note="Description of Artificial Sequence: Synthetic peptide"
GYYMH

SEQ ID NO: 1228 - protein, 5 aa, Artificial Sequence
  source: /note="Description of Artificial Sequence: Synthetic peptide"
GYYMH

SEQ ID NO: 1229 - protein, 5 aa, Artificial Sequence
  source: /note="Description of Artificial Sequence: Synthetic peptide"
GYYMH

SEQ ID NO: 1230 - protein, 5 aa, Artificial Sequence
  source: /note="Description of Artificial Sequence: Synthetic peptide"
GYYMH

SEQ ID NO: 1231 - protein, 5 aa, Artificial Sequence
  source: /note="Description of Artificial Sequence: Synthetic peptide"
GYYMH

SEQ ID NO: 1232 - protein, 5 aa, Artificial Sequence
  source: /note="Description of Artificial Sequence: Synthetic peptide"
GYYMH

SEQ ID NO: 1233 - protein, 5 aa, Artificial Sequence
  source: /note="Description of Artificial Sequence: Synthetic peptide"
GYYMH

SEQ ID NO: 1234 - protein, 5 aa, Artificial Sequence
  source: /note="Description of Artificial Sequence: Synthetic peptide"
GYYMH

SEQ ID NO: 1235 - protein, 5 aa, Artificial Sequence
  source: /note="Description of Artificial Sequence: Synthetic peptide"
GYYMH

SEQ ID NO: 1236 - protein, 5 aa, Artificial Sequence
  source: /note="Description of Artificial Sequence: Synthetic peptide"
GYYMH

SEQ ID NO: 1237 - protein, 5 aa, Artificial Sequence
  source: /note="Description of Artificial Sequence: Synthetic peptide"
NFGMH

SEQ ID NO: 1238 - protein, 5 aa, Artificial Sequence
  source: /note="Description of Artificial Sequence: Synthetic peptide"
YFGMH

SEQ ID NO: 1239 - protein, 5 aa, Artificial Sequence
  source: /note="Description of Artificial Sequence: Synthetic peptide"
GYYMH

SEQ ID NO: 1240 - protein, 5 aa, Artificial Sequence
  source: /note="Description of Artificial Sequence: Synthetic peptide"
SYGIH

SEQ ID NO: 1241 - protein, 5 aa, Artificial Sequence
  source: /note="Description of Artificial Sequence: Synthetic peptide"
SYDIN

SEQ ID NO: 1242 - protein, 5 aa, Artificial Sequence
  source: /note="Description of Artificial Sequence: Synthetic peptide"
SYGIH

SEQ ID NO: 1243 - protein, 5 aa, Artificial Sequence
  source: /note="Description of Artificial Sequence: Synthetic peptide"
SYGIH

SEQ ID NO: 1244 - protein, 5 aa, Artificial Sequence
  source: /note="Description of Artificial Sequence: Synthetic peptide"
SYGIH

SEQ ID NO: 1245 - protein, 5 aa, Artificial Sequence
  source: /note="Description of Artificial Sequence: Synthetic peptide"
SYGIH

SEQ ID NO: 1246 - protein, 5 aa, Artificial Sequence
  source: /note="Description of Artificial Sequence: Synthetic peptide"
SYGIH

SEQ ID NO: 1247 - protein, 5 aa, Artificial Sequence
  source: /note="Description of Artificial Sequence: Synthetic peptide"
SYGIH

SEQ ID NO: 1248 - protein, 5 aa, Artificial Sequence
  source: /note="Description of Artificial Sequence: Synthetic peptide"
SYDIN

SEQ ID NO: 1249 - protein, 5 aa, Artificial Sequence
  source: /note="Description of Artificial Sequence: Synthetic peptide"
SYDIN

SEQ ID NO: 1250 - protein, 5 aa, Artificial Sequence
  source: /note="Description of Artificial Sequence: Synthetic peptide"
SYDIN

SEQ ID NO: 1251 - protein, 5 aa, Artificial Sequence
  source: /note="Description of Artificial Sequence: Synthetic peptide"
SYDIN

SEQ ID NO: 1252 - protein, 5 aa, Artificial Sequence
  source: /note="Description of Artificial Sequence: Synthetic peptide"
SYDIN

SEQ ID NO: 1253 - protein, 5 aa, Artificial Sequence
  source: /note="Description of Artificial Sequence: Synthetic peptide"
SYDIN

SEQ ID NO: 1254 - protein, 5 aa, Artificial Sequence
  source: /note="Description of Artificial Sequence: Synthetic peptide"
SYDIN

SEQ ID NO: 1255 - protein, 5 aa, Artificial Sequence
  source: /note="Description of Artificial Sequence: Synthetic peptide"
SYDIN

SEQ ID NO: 1256 - protein, 5 aa, Artificial Sequence
  source: /note="Description of Artificial Sequence: Synthetic peptide"
SYGIH

SEQ ID NO: 1257 - protein, 17 aa, Artificial Sequence
  source: /note="Description of Artificial Sequence: Synthetic peptide"
WINPNSGGTNYAQKFQG

SEQ ID NO: 1258 - protein, 17 aa, Artificial Sequence
  source: /note="Description of Artificial Sequence: Synthetic peptide"
VIWYDGSNENYADSVKG

SEQ ID NO: 1259 - protein, 17 aa, Artificial Sequence
  source: /note="Description of Artificial Sequence: Synthetic peptide"
VIWYDGSNKYYADSVKG

SEQ ID NO: 1260 - protein, 17 aa, Artificial Sequence
  source: /note="Description of Artificial Sequence: Synthetic peptide"
VIWYDGSNKYYADSVKG

SEQ ID NO: 1261 - protein, 17 aa, Artificial Sequence
  source: /note="Description of Artificial Sequence: Synthetic peptide"
WINPDSGGTDYSQRFQG

SEQ ID NO: 1262 - protein, 17 aa, Artificial Sequence
  source: /note="Description of Artificial Sequence: Synthetic peptide"
WINPDSGGTDYSQRFQG

SEQ ID NO: 1263 - protein, 17 aa, Artificial Sequence
  source: /note="Description of Artificial Sequence: Synthetic peptide"
WISPNSGDTSYAQKFQD

SEQ ID NO: 1264 - protein, 17 aa, Artificial Sequence
  source: /note="Description of Artificial Sequence: Synthetic peptide"
WISPNNGDTNYAQKFQD

SEQ ID NO: 1265 - protein, 16 aa, Artificial Sequence
  source: /note="Description of Artificial Sequence: Synthetic peptide"
YIYYSGSTYYNPSLKS

SEQ ID NO: 1266 - protein, 17 aa, Artificial Sequence
  source: /note="Description of Artificial Sequence: Synthetic peptide"
AIWFDGSDKYYADSVKG

SEQ ID NO: 1267 - protein, 17 aa, Artificial Sequence
  source: /note="Description of Artificial Sequence: Synthetic peptide"
VIWYDGSNKYYADSVKG

SEQ ID NO: 1268 - protein, 17 aa, Artificial Sequence
  source: /note="Description of Artificial Sequence: Synthetic peptide"
AIWYDGNNKYYADSVKG

SEQ ID NO: 1269 - protein, 16 aa, Artificial Sequence
  source: /note="Description of Artificial Sequence: Synthetic peptide"
RIYTSGSTNYNPSLKS

SEQ ID NO: 1270 - protein, 16 aa, Artificial Sequence
  source: /note="Description of Artificial Sequence: Synthetic peptide"
RIYTSGSTNYNPSLKS

SEQ ID NO: 1271 - protein, 17 aa, Artificial Sequence
  source: /note="Description of Artificial Sequence: Synthetic peptide"
VIWYDASNKYYADAVKG

SEQ ID NO: 1272 - protein, 17 aa, Artificial Sequence
  source: /note="Description of Artificial Sequence: Synthetic peptide"
VIWYDASNKYYADSVKG

SEQ ID NO: 1273 - protein, 17 aa, Artificial Sequence
  source: /note="Description of Artificial Sequence: Synthetic peptide"
VIWYDGSNKYYADAVKG

SEQ ID NO: 1274 - protein, 17 aa, Artificial Sequence
  source: /note="Description of Artificial Sequence: Synthetic peptide"
VIWYDASNKYYADAVKG

SEQ ID NO: 1275 - protein, 17 aa, Artificial Sequence
  source: /note="Description of Artificial Sequence: Synthetic peptide"
VIWYDASNKYYADAVKG

SEQ ID NO: 1276 - protein, 17 aa, Artificial Sequence
  source: /note="Description of Artificial Sequence: Synthetic peptide"
VIWYDASNKYYADAVKG

SEQ ID NO: 1277 - protein, 17 aa, Artificial Sequence
  source: /note="Description of Artificial Sequence: Synthetic peptide"
VIWYDASNENYADAVKG

SEQ ID NO: 1278 - protein, 17 aa, Artificial Sequence
  source: /note="Description of Artificial Sequence: Synthetic peptide"
VIWYDASNENYADAVKG

SEQ ID NO: 1279 - protein, 17 aa, Artificial Sequence
  source: /note="Description of Artificial Sequence: Synthetic peptide"
VIWYDASNENYADAVKG

SEQ ID NO: 1280 - protein, 17 aa, Artificial Sequence
  source: /note="Description of Artificial Sequence: Synthetic peptide"
VIWYDASNENYADSVKG

SEQ ID NO: 1281 - protein, 17 aa, Artificial Sequence
  source: /note="Description of Artificial Sequence: Synthetic peptide"
VIWYDGSNENYADAVKG

SEQ ID NO: 1282 - protein, 17 aa, Artificial Sequence
  source: /note="Description of Artificial Sequence: Synthetic peptide"
VIWYDASNENYADAVKG

SEQ ID NO: 1283 - protein, 17 aa, Artificial Sequence
  source: /note="Description of Artificial Sequence: Synthetic peptide"
VIWYDASNENYADAVKG

SEQ ID NO: 1284 - protein, 17 aa, Artificial Sequence
  source: /note="Description of Artificial Sequence: Synthetic peptide"
VIWYDGSNENYADSVKG

SEQ ID NO: 1285 - protein, 17 aa, Artificial Sequence
  source: /note="Description of Artificial Sequence: Synthetic peptide"
VIWYDASNENYADAVKG

SEQ ID NO: 1286 - protein, 17 aa, Artificial Sequence
  source: /note="Description of Artificial Sequence: Synthetic peptide"
VIWYDASNENYADAVKG

SEQ ID NO: 1287 - protein, 17 aa, Artificial Sequence
  source: /note="Description of Artificial Sequence: Synthetic peptide"
VIWYDASNENYADAVKG

SEQ ID NO: 1288 - protein, 17 aa, Artificial Sequence
  source: /note="Description of Artificial Sequence: Synthetic peptide"
VIWYDASNENYADAVKG

SEQ ID NO: 1289 - protein, 17 aa, Artificial Sequence
  source: /note="Description of Artificial Sequence: Synthetic peptide"
VIWYDASNENYADAVKG

SEQ ID NO: 1290 - protein, 17 aa, Artificial Sequence
  source: /note="Description of Artificial Sequence: Synthetic peptide"
VIWYDASNENYADAVKG

SEQ ID NO: 1291 - protein, 17 aa, Artificial Sequence
  source: /note="Description of Artificial Sequence: Synthetic peptide"
VIWYDASNENYADAVKG

SEQ ID NO: 1292 - protein, 17 aa, Artificial Sequence
  source: /note="Description of Artificial Sequence: Synthetic peptide"
VIWYDGSNENYADAVKG

SEQ ID NO: 1293 - protein, 17 aa, Artificial Sequence
  source: /note="Description of Artificial Sequence: Synthetic peptide"
VIWYDASNENYADSVKG

SEQ ID NO: 1294 - protein, 17 aa, Artificial Sequence
  source: /note="Description of Artificial Sequence: Synthetic peptide"
VIWYDASNENYADAVKG

SEQ ID NO: 1295 - protein, 17 aa, Artificial Sequence
  source: /note="Description of Artificial Sequence: Synthetic peptide"
VIWYDASNENYADAVKG

SEQ ID NO: 1296 - protein, 17 aa, Artificial Sequence
  source: /note="Description of Artificial Sequence: Synthetic peptide"
VIWYDASNKYYADAVKG

SEQ ID NO: 1297 - protein, 17 aa, Artificial Sequence
  source: /note="Description of Artificial Sequence: Synthetic peptide"
VIWYDASNKYYADAVKG

SEQ ID NO: 1298 - protein, 17 aa, Artificial Sequence
  source: /note="Description of Artificial Sequence: Synthetic peptide"
VIWYDASNKYYADAVKG

SEQ ID NO: 1299 - protein, 17 aa, Artificial Sequence
  source: /note="Description of Artificial Sequence: Synthetic peptide"
VIWYDASNKYYADAVKG

SEQ ID NO: 1300 - protein, 17 aa, Artificial Sequence
  source: /note="Description of Artificial Sequence: Synthetic peptide"
VIWYDASNKYYADAVKG

SEQ ID NO: 1301 - protein, 17 aa, Artificial Sequence
  source: /note="Description of Artificial Sequence: Synthetic peptide"
VIWYDASNKYYADAVKG

SEQ ID NO: 1302 - protein, 17 aa, Artificial Sequence
  source: /note="Description of Artificial Sequence: Synthetic peptide"
VIWYDASNKYYADAVKG

SEQ ID NO: 1303 - protein, 17 aa, Artificial Sequence
  source: /note="Description of Artificial Sequence: Synthetic peptide"
VIWYDASNKYYADSVKG

SEQ ID NO: 1304 - protein, 17 aa, Artificial Sequence
  source: /note="Description of Artificial Sequence: Synthetic peptide"
VIWYDGSNKYYADAVKG

SEQ ID NO: 1305 - protein, 17 aa, Artificial Sequence
  source: /note="Description of Artificial Sequence: Synthetic peptide"
VIWYDASNKYYADAVKG

SEQ ID NO: 1306 - protein, 17 aa, Artificial Sequence
  source: /note="Description of Artificial Sequence: Synthetic peptide"
VIWYDASNKYYADAVKG

SEQ ID NO: 1307 - protein, 17 aa, Artificial Sequence
  source: /note="Description of Artificial Sequence: Synthetic peptide"
VIWYDASNKYYADAVKG

SEQ ID NO: 1308 - protein, 17 aa, Artificial Sequence
  source: /note="Description of Artificial Sequence: Synthetic peptide"
VIWYDASNKYYADAVKG

SEQ ID NO: 1309 - protein, 17 aa, Artificial Sequence
  source: /note="Description of Artificial Sequence: Synthetic peptide"
VIWYDGSNKYYADSVKG

SEQ ID NO: 1310 - protein, 17 aa, Artificial Sequence
  source: /note="Description of Artificial Sequence: Synthetic peptide"
VIWYDASNKYYADSVKG

SEQ ID NO: 1311 - protein, 17 aa, Artificial Sequence
  source: /note="Description of Artificial Sequence: Synthetic peptide"
VIWYDGSNKYYADAVKG

SEQ ID NO: 1312 - protein, 17 aa, Artificial Sequence
  source: /note="Description of Artificial Sequence: Synthetic peptide"
AIWYDANNKYYADAVKG

SEQ ID NO: 1313 - protein, 17 aa, Artificial Sequence
  source: /note="Description of Artificial Sequence: Synthetic peptide"
AIWYDANNKYYADAVKG

SEQ ID NO: 1314 - protein, 17 aa, Artificial Sequence
  source: /note="Description of Artificial Sequence: Synthetic peptide"
AIWYDANNKYYADAVKG

SEQ ID NO: 1315 - protein, 17 aa, Artificial Sequence
  source: /note="Description of Artificial Sequence: Synthetic peptide"
AIWYDANNKYYADAVKG

SEQ ID NO: 1316 - protein, 17 aa, Artificial Sequence
  source: /note="Description of Artificial Sequence: Synthetic peptide"
AIWYDANNKYYADAVKG

SEQ ID NO: 1317 - protein, 17 aa, Artificial Sequence
  source: /note="Description of Artificial Sequence: Synthetic peptide"
AIWYDANNKYYADAVKG

SEQ ID NO: 1318 - protein, 17 aa, Artificial Sequence
  source: /note="Description of Artificial Sequence: Synthetic peptide"
AIWYDANNKYYADAVKG

SEQ ID NO: 1319 - protein, 17 aa, Artificial Sequence
  source: /note="Description of Artificial Sequence: Synthetic peptide"
AIWYDGNNKYYADAVKG

SEQ ID NO: 1320 - protein, 17 aa, Artificial Sequence
  source: /note="Description of Artificial Sequence: Synthetic peptide"
AIWYDANNKYYADSVKG

SEQ ID NO: 1321 - protein, 17 aa, Artificial Sequence
  source: /note="Description of Artificial Sequence: Synthetic peptide"
AIWYDANNKYYADAVKG

SEQ ID NO: 1322 - protein, 17 aa, Artificial Sequence
  source: /note="Description of Artificial Sequence: Synthetic peptide"
AIWYDANNKYYADAVKG

SEQ ID NO: 1323 - protein, 17 aa, Artificial Sequence
  source: /note="Description of Artificial Sequence: Synthetic peptide"
VIWYDASNKYYEDAVKG

SEQ ID NO: 1324 - protein, 17 aa, Artificial Sequence
  source: /note="Description of Artificial Sequence: Synthetic peptide"
VIWYDGSNKYYEDSVKG

SEQ ID NO: 1325 - protein, 17 aa, Artificial Sequence
  source: /note="Description of Artificial Sequence: Synthetic peptide"
VIWYDGSNKYYEDAVKG

SEQ ID NO: 1326 - protein, 17 aa, Artificial Sequence
  source: /note="Description of Artificial Sequence: Synthetic peptide"
VIWYDASNKYYEDSVKG

SEQ ID NO: 1327 - protein, 17 aa, Artificial Sequence
  source: /note="Description of Artificial Sequence: Synthetic peptide"
AIWFDASDKYYADAVKG

SEQ ID NO: 1328 - protein, 17 aa, Artificial Sequence
  source: /note="Description of Artificial Sequence: Synthetic peptide"
AIWFDASDKYYADSVKG

SEQ ID NO: 1329 - protein, 17 aa, Artificial Sequence
  source: /note="Description of Artificial Sequence: Synthetic peptide"
AIWFDGSDKYYADAVKG

SEQ ID NO: 1330 - protein, 17 aa, Artificial Sequence
  source: /note="Description of Artificial Sequence: Synthetic peptide"
AIWFDASDKYYADAVKG

SEQ ID NO: 1331 - protein, 17 aa, Artificial Sequence
  source: /note="Description of Artificial Sequence: Synthetic peptide"
AIWFDASDKYYADAVKG

SEQ ID NO: 1332 - protein, 17 aa, Artificial Sequence
  source: /note="Description of Artificial Sequence: Synthetic peptide"
AIWFDASDKYYADAVKG

SEQ ID NO: 1333 - protein, 17 aa, Artificial Sequence
  source: /note="Description of Artificial Sequence: Synthetic peptide"
AIWFDASDKYYADAVKG

SEQ ID NO: 1334 - protein, 17 aa, Artificial Sequence
  source: /note="Description of Artificial Sequence: Synthetic peptide"
AIWFDASDKYYADAVKG

SEQ ID NO: 1335 - protein, 16 aa, Artificial Sequence
  source: /note="Description of Artificial Sequence: Synthetic peptide"
YIYYSGSTYYNPSLKS

SEQ ID NO: 1336 - protein, 16 aa, Artificial Sequence
  source: /note="Description of Artificial Sequence: Synthetic peptide"
YIYYSGSTYYNPSLKS

SEQ ID NO: 1337 - protein, 16 aa, Artificial Sequence
  source: /note="Description of Artificial Sequence: Synthetic peptide"
YIYYSGSTYYNPSLKS

SEQ ID NO: 1338 - protein, 16 aa, Artificial Sequence
  source: /note="Description of Artificial Sequence: Synthetic peptide"
YIYYSGSTYYNPSLKS

SEQ ID NO: 1339 - protein, 16 aa, Artificial Sequence
  source: /note="Description of Artificial Sequence: Synthetic peptide"
YIYYSGSTYYNPSLKS

SEQ ID NO: 1340 - protein, 16 aa, Artificial Sequence
  source: /note="Description of Artificial Sequence: Synthetic peptide"
YIYYSGSTYYNPSLKS

SEQ ID NO: 1341 - protein, 16 aa, Artificial Sequence
  source: /note="Description of Artificial Sequence: Synthetic peptide"
YIYYSGSTYYNPSLKS

SEQ ID NO: 1342 - protein, 17 aa, Artificial Sequence
  source: /note="Description of Artificial Sequence: Synthetic peptide"
WINPESGGTDYSQRFQG

SEQ ID NO: 1343 - protein, 17 aa, Artificial Sequence
  source: /note="Description of Artificial Sequence: Synthetic peptide"
WINPESGGTDYSQRFQG

SEQ ID NO: 1344 - protein, 17 aa, Artificial Sequence
  source: /note="Description of Artificial Sequence: Synthetic peptide"
WINPDAGGTDYSQRFQG

SEQ ID NO: 1345 - protein, 17 aa, Artificial Sequence
  source: /note="Description of Artificial Sequence: Synthetic peptide"
WINPDAGGTDYSQRFQG

SEQ ID NO: 1346 - protein, 17 aa, Artificial Sequence
  source: /note="Description of Artificial Sequence: Synthetic peptide"
WINPDSGGTDYSQRFQG

SEQ ID NO: 1347 - protein, 17 aa, Artificial Sequence
  source: /note="Description of Artificial Sequence: Synthetic peptide"
WINPDSGGTDYSQRFQG

SEQ ID NO: 1348 - protein, 17 aa, Artificial Sequence
  source: /note="Description of Artificial Sequence: Synthetic peptide"
WINPDSGGTDYSQRFQG

SEQ ID NO: 1349 - protein, 17 aa, Artificial Sequence
  source: /note="Description of Artificial Sequence: Synthetic peptide"
WINPDAGGTDYSQRFQG

SEQ ID NO: 1350 - protein, 17 aa, Artificial Sequence
  source: /note="Description of Artificial Sequence: Synthetic peptide"
WINPDAGGTDYSQRFQG

SEQ ID NO: 1351 - protein, 17 aa, Artificial Sequence
  source: /note="Description of Artificial Sequence: Synthetic peptide"
WINPDAGGTDYSQRFQG

SEQ ID NO: 1352 - protein, 17 aa, Artificial Sequence
  source: /note="Description of Artificial Sequence: Synthetic peptide"
WINPESGGTDYSQRFQG

SEQ ID NO: 1353 - protein, 17 aa, Artificial Sequence
  source: /note="Description of Artificial Sequence: Synthetic peptide"
WISPNSGETSYAQKFQD

SEQ ID NO: 1354 - protein, 17 aa, Artificial Sequence
  source: /note="Description of Artificial Sequence: Synthetic peptide"
WISPNSGDTSYAQKFQD

SEQ ID NO: 1355 - protein, 17 aa, Artificial Sequence
  source: /note="Description of Artificial Sequence: Synthetic peptide"
WISPNSGETSYAQKFQD

SEQ ID NO: 1356 - protein, 17 aa, Artificial Sequence
  source: /note="Description of Artificial Sequence: Synthetic peptide"
WISPNSGETSYAQKFQD

SEQ ID NO: 1357 - protein, 17 aa, Artificial Sequence
  source: /note="Description of Artificial Sequence: Synthetic peptide"
WISPNSGDTSYAQKFQD

SEQ ID NO: 1358 - protein, 17 aa, Artificial Sequence
  source: /note="Description of Artificial Sequence: Synthetic peptide"
WISPNSGETSYAQKFQD

SEQ ID NO: 1359 - protein, 17 aa, Artificial Sequence
  source: /note="Description of Artificial Sequence: Synthetic peptide"
WISPNSGDTSYAQKFQD

SEQ ID NO: 1360 - protein, 17 aa, Artificial Sequence
  source: /note="Description of Artificial Sequence: Synthetic peptide"
WISPNSGETSYAQKFQD

SEQ ID NO: 1361 - protein, 17 aa, Artificial Sequence
  source: /note="Description of Artificial Sequence: Synthetic peptide"
WISPNSGETSYAQKFQD

SEQ ID NO: 1362 - protein, 17 aa, Artificial Sequence
  source: /note="Description of Artificial Sequence: Synthetic peptide"
WINPESGGTDYSQRFQG

SEQ ID NO: 1363 - protein, 17 aa, Artificial Sequence
  source: /note="Description of Artificial Sequence: Synthetic peptide"
WINPESGGTDYSQRFQG

SEQ ID NO: 1364 - protein, 17 aa, Artificial Sequence
  source: /note="Description of Artificial Sequence: Synthetic peptide"
WINPDSGGTDYSQRFQG

SEQ ID NO: 1365 - protein, 17 aa, Artificial Sequence
  source: /note="Description of Artificial Sequence: Synthetic peptide"
WINPESGGTDYSQRFQG

SEQ ID NO: 1366 - protein, 17 aa, Artificial Sequence
  source: /note="Description of Artificial Sequence: Synthetic peptide"
WINPESGGTDYSQRFQG

SEQ ID NO: 1367 - protein, 17 aa, Artificial Sequence
  source: /note="Description of Artificial Sequence: Synthetic peptide"
WISPNQGETNYAQKFQD

SEQ ID NO: 1368 - protein, 17 aa, Artificial Sequence
  source: /note="Description of Artificial Sequence: Synthetic peptide"
WISPNQGDTNYAQKFQD

SEQ ID NO: 1369 - protein, 17 aa, Artificial Sequence
  source: /note="Description of Artificial Sequence: Synthetic peptide"
WISPNQGETNYAQKFQD

SEQ ID NO: 1370 - protein, 17 aa, Artificial Sequence
  source: /note="Description of Artificial Sequence: Synthetic peptide"
WISPNNGETNYAQKFQD

SEQ ID NO: 1371 - protein, 17 aa, Artificial Sequence
  source: /note="Description of Artificial Sequence: Synthetic peptide"
WISPNNGDTNYAQKFQD

SEQ ID NO: 1372 - protein, 17 aa, Artificial Sequence
  source: /note="Description of Artificial Sequence: Synthetic peptide"
WISPNQGDTNYAQKFQD

SEQ ID NO: 1373 - protein, 17 aa, Artificial Sequence
  source: /note="Description of Artificial Sequence: Synthetic peptide"
WISPNNGETNYAQKFQD

SEQ ID NO: 1374 - protein, 17 aa, Artificial Sequence
  source: /note="Description of Artificial Sequence: Synthetic peptide"
WISPNQGETNYAQKFQD

SEQ ID NO: 1375 - protein, 17 aa, Artificial Sequence
  source: /note="Description of Artificial Sequence: Synthetic peptide"
WISPNNGDTNYAQKFQD

SEQ ID NO: 1376 - protein, 17 aa, Artificial Sequence
  source: /note="Description of Artificial Sequence: Synthetic peptide"
WISPNQGDTNYAQKFQD

SEQ ID NO: 1377 - protein, 17 aa, Artificial Sequence
  source: /note="Description of Artificial Sequence: Synthetic peptide"
WISPNNGETNYAQKFQD

SEQ ID NO: 1378 - protein, 17 aa, Artificial Sequence
  source: /note="Description of Artificial Sequence: Synthetic peptide"
WISPNQGETNYAQKFQD

SEQ ID NO: 1379 - protein, 17 aa, Artificial Sequence
  source: /note="Description of Artificial Sequence: Synthetic peptide"
WISPNQGETNYAQKFQD

SEQ ID NO: 1380 - protein, 17 aa, Artificial Sequence
  source: /note="Description of Artificial Sequence: Synthetic peptide"
WINPNSGGTNYAQKFQG

SEQ ID NO: 1381 - protein, 17 aa, Artificial Sequence
  source: /note="Description of Artificial Sequence: Synthetic peptide"
WINPNSGGTNYAQKFQG

SEQ ID NO: 1382 - protein, 17 aa, Artificial Sequence
  source: /note="Description of Artificial Sequence: Synthetic peptide"
WINPNSGGTNYAQKFQG

SEQ ID NO: 1383 - protein, 17 aa, Artificial Sequence
  source: /note="Description of Artificial Sequence: Synthetic peptide"
WINPNSGGTNYAQKFQG

SEQ ID NO: 1384 - protein, 17 aa, Artificial Sequence
  source: /note="Description of Artificial Sequence: Synthetic peptide"
WINPNSGGTNYAQKFQG

SEQ ID NO: 1385 - protein, 17 aa, Artificial Sequence
  source: /note="Description of Artificial Sequence: Synthetic peptide"
WINPNSGGTNYAQKFQG

SEQ ID NO: 1386 - protein, 17 aa, Artificial Sequence
  source: /note="Description of Artificial Sequence: Synthetic peptide"
WINPNSGGTNYAQKFQG

SEQ ID NO: 1387 - protein, 17 aa, Artificial Sequence
  source: /note="Description of Artificial Sequence: Synthetic peptide"
WINPNSGGTNYAQKFQG

SEQ ID NO: 1388 - protein, 17 aa, Artificial Sequence
  source: /note="Description of Artificial Sequence: Synthetic peptide"
WINPNSGGTNYAQKFQG

SEQ ID NO: 1389 - protein, 17 aa, Artificial Sequence
  source: /note="Description of Artificial Sequence: Synthetic peptide"
WINPNSGGTNYAQKFQG

SEQ ID NO: 1390 - protein, 17 aa, Artificial Sequence
  source: /note="Description of Artificial Sequence: Synthetic peptide"
WINPNSGGTNYAQKFQG

SEQ ID NO: 1391 - protein, 17 aa, Artificial Sequence
  source: /note="Description of Artificial Sequence: Synthetic peptide"
WINPNSGGTNYAQKFQG

SEQ ID NO: 1392 - protein, 17 aa, Artificial Sequence
  source: /note="Description of Artificial Sequence: Synthetic peptide"
WINPNSGGTNYAQKFQG

SEQ ID NO: 1393 - protein, 17 aa, Artificial Sequence
  source: /note="Description of Artificial Sequence: Synthetic peptide"
WINPNSGGTNYAQKFQG

SEQ ID NO: 1394 - protein, 17 aa, Artificial Sequence
  source: /note="Description of Artificial Sequence: Synthetic peptide"
VIWYDASNENYADAVKG

SEQ ID NO: 1395 - protein, 17 aa, Artificial Sequence
  source: /note="Description of Artificial Sequence: Synthetic peptide"
VIWYDASNKYYADAVKG

SEQ ID NO: 1396 - protein, 17 aa, Artificial Sequence
  source: /note="Description of Artificial Sequence: Synthetic peptide"
WINPNSGGTNYAQKFQG

SEQ ID NO: 1397 - protein, 17 aa, Artificial Sequence
  source: /note="Description of Artificial Sequence: Synthetic peptide"
VIWYDGSNKFHADSVKG

SEQ ID NO: 1398 - protein, 17 aa, Artificial Sequence
  source: /note="Description of Artificial Sequence: Synthetic peptide"
WMNPNSGNTGYAQKFQG

SEQ ID NO: 1399 - protein, 17 aa, Artificial Sequence
  source: /note="Description of Artificial Sequence: Synthetic peptide"
VIWYDASNKFHADAVKG

SEQ ID NO: 1400 - protein, 17 aa, Artificial Sequence
  source: /note="Description of Artificial Sequence: Synthetic peptide"
VIWYDASNKFHADAVKG

SEQ ID NO: 1401 - protein, 17 aa, Artificial Sequence
  source: /note="Description of Artificial Sequence: Synthetic peptide"
VIWYDASNKFHADAVKG

SEQ ID NO: 1402 - protein, 17 aa, Artificial Sequence
  source: /note="Description of Artificial Sequence: Synthetic peptide"
VIWYDASNKFHADAVKG

SEQ ID NO: 1403 - protein, 17 aa, Artificial Sequence
  source: /note="Description of Artificial Sequence: Synthetic peptide"
VIWYDASNKFHADSVKG

SEQ ID NO: 1404 - protein, 17 aa, Artificial Sequence
  source: /note="Description of Artificial Sequence: Synthetic peptide"
VIWYDGSNKFHADAVKG

SEQ ID NO: 1405 - protein, 17 aa, Artificial Sequence
  source: /note="Description of Artificial Sequence: Synthetic peptide"
WMNPNSGGTGYAQKFQG

SEQ ID NO: 1406 - protein, 17 aa, Artificial Sequence
  source: /note="Description of Artificial Sequence: Synthetic peptide"
WMNPNSGNTGYAQKFQG

SEQ ID NO: 1407 - protein, 17 aa, Artificial Sequence
  source: /note="Description of Artificial Sequence: Synthetic peptide"
WMNPNSGGTGYAQKFQG

SEQ ID NO: 1408 - protein, 17 aa, Artificial Sequence
  source: /note="Description of Artificial Sequence: Synthetic peptide"
WMNPNSGGTGYAQKFQG

SEQ ID NO: 1409 - protein, 17 aa, Artificial Sequence
  source: /note="Description of Artificial Sequence: Synthetic peptide"
WMNPNSGGTGYAQKFQG

SEQ ID NO: 1410 - protein, 17 aa, Artificial Sequence
  source: /note="Description of Artificial Sequence: Synthetic peptide"
WMNPNSGNTGYAQKFQG

SEQ ID NO: 1411 - protein, 17 aa, Artificial Sequence
  source: /note="Description of Artificial Sequence: Synthetic peptide"
WMNPNSGGTGYAQKFQG

SEQ ID NO: 1412 - protein, 17 aa, Artificial Sequence
  source: /note="Description of Artificial Sequence: Synthetic peptide"
WMNPNSGGTGYAQKFQG

SEQ ID NO: 1413 - protein, 17 aa, Artificial Sequence
  source: /note="Description of Artificial Sequence: Synthetic peptide"
VIWYDASNKFHADAVKG

SEQ ID NO: 1414 - protein, 19 aa, Artificial Sequence
  source: /note="Description of Artificial Sequence: Synthetic peptide"
GGDYVWGTYRPHYYYGMDV

SEQ ID NO: 1415 - protein, 12 aa, Artificial Sequence
  source: /note="Description of Artificial Sequence: Synthetic peptide"
DGTIFGVVLGDY

SEQ ID NO: 1416 - protein, 12 aa, Artificial Sequence
  source: /note="Description of Artificial Sequence: Synthetic peptide"
DGTIFGVLLGDY

SEQ ID NO: 1417 - protein, 11 aa, Artificial Sequence
  source: /note="Description of Artificial Sequence: Synthetic peptide"
DRTIFGVVLDY

SEQ ID NO: 1418 - protein, 14 aa, Artificial Sequence
  source: /note="Description of Artificial Sequence: Synthetic peptide"
EATIFGMVIVPFDY

SEQ ID NO: 1419 - protein, 14 aa, Artificial Sequence
  source: /note="Description of Artificial Sequence: Synthetic peptide"
EATIFGMVIVPFDY

SEQ ID NO: 1420 - protein, 14 aa, Artificial Sequence
  source: /note="Description of Artificial Sequence: Synthetic peptide"
EATIFGMLIVPFDY

SEQ ID NO: 1421 - protein, 14 aa, Artificial Sequence
  source: /note="Description of Artificial Sequence: Synthetic peptide"
EATIFGMLIVPFDY

SEQ ID NO: 1422 - protein, 16 aa, Artificial Sequence
  source: /note="Description of Artificial Sequence: Synthetic peptide"
DRITIFGVVMGGGMDV

SEQ ID NO: 1423 - protein, 11 aa, Artificial Sequence
  source: /note="Description of Artificial Sequence: Synthetic peptide"
DQAIFGVVPDY

SEQ ID NO: 1424 - protein, 12 aa, Artificial Sequence
  source: /note="Description of Artificial Sequence: Synthetic peptide"
DGTIFGVLLGDY

SEQ ID NO: 1425 - protein, 11 aa, Artificial Sequence
  source: /note="Description of Artificial Sequence: Synthetic peptide"
DRTIFGVVLEY

SEQ ID NO: 1426 - protein, 9 aa, Artificial Sequence
  source: /note="Description of Artificial Sequence: Synthetic peptide"
DVAVAGFDY

SEQ ID NO: 1427 - protein, 9 aa, Artificial Sequence
  source: /note="Description of Artificial Sequence: Synthetic peptide"
DVAVAGFDY

SEQ ID NO: 1428 - protein, 12 aa, Artificial Sequence
  source: /note="Description of Artificial Sequence: Synthetic peptide"
DGTIFGVLLGDY

SEQ ID NO: 1429 - protein, 12 aa, Artificial Sequence
  source: /note="Description of Artificial Sequence: Synthetic peptide"
DGTIFGVLLGDY

SEQ ID NO: 1430 - protein, 12 aa, Artificial Sequence
  source: /note="Description of Artificial Sequence: Synthetic peptide"
DGTIFGVLLGDY

SEQ ID NO: 1431 - protein, 12 aa, Artificial Sequence
  source: /note="Description of Artificial Sequence: Synthetic peptide"
DGTIFGVLLGDY

SEQ ID NO: 1432 - protein, 12 aa, Artificial Sequence
  source: /note="Description of Artificial Sequence: Synthetic peptide"
DGTIFGVLLGDY

SEQ ID NO: 1433 - protein, 12 aa, Artificial Sequence
  source: /note="Description of Artificial Sequence: Synthetic peptide"
DRTIFGVLLGDY

SEQ ID NO: 1434 - protein, 12 aa, Artificial Sequence
  source: /note="Description of Artificial Sequence: Synthetic peptide"
DGTIFGVVLGDY

SEQ ID NO: 1435 - protein, 12 aa, Artificial Sequence
  source: /note="Description of Artificial Sequence: Synthetic peptide"
DGTIFGVVLGDY

SEQ ID NO: 1436 - protein, 12 aa, Artificial Sequence
  source: /note="Description of Artificial Sequence: Synthetic peptide"
DGTIFGVVLGDY

SEQ ID NO: 1437 - protein, 12 aa, Artificial Sequence
  source: /note="Description of Artificial Sequence: Synthetic peptide"
DGTIFGVVLGDY

SEQ ID NO: 1438 - protein, 12 aa, Artificial Sequence
  source: /note="Description of Artificial Sequence: Synthetic peptide"
DGTIFGVVLGDY

SEQ ID NO: 1439 - protein, 12 aa, Artificial Sequence
  source: /note="Description of Artificial Sequence: Synthetic peptide"
DRTIFGVVLGDY

SEQ ID NO: 1440 - protein, 12 aa, Artificial Sequence
  source: /note="Description of Artificial Sequence: Synthetic peptide"
DGTIFGVVLGDY

SEQ ID NO: 1441 - protein, 12 aa, Artificial Sequence
  source: /note="Description of Artificial Sequence: Synthetic peptide"
DGTIFGVVLGDY

SEQ ID NO: 1442 - protein, 12 aa, Artificial Sequence
  source: /note="Description of Artificial Sequence: Synthetic peptide"
DGTIFGVVLGDY

SEQ ID NO: 1443 - protein, 12 aa, Artificial Sequence
  source: /note="Description of Artificial Sequence: Synthetic peptide"
DGTIFGVVLGDY

SEQ ID NO: 1444 - protein, 12 aa, Artificial Sequence
  source: /note="Description of Artificial Sequence: Synthetic peptide"
DGTIFGVVLGDY

SEQ ID NO: 1445 - protein, 12 aa, Artificial Sequence
  source: /note="Description of Artificial Sequence: Synthetic peptide"
DGTIFGVVLGDY

SEQ ID NO: 1446 - protein, 12 aa, Artificial Sequence
  source: /note="Description of Artificial Sequence: Synthetic peptide"
DGTIFGVVLGDY

SEQ ID NO: 1447 - protein, 12 aa, Artificial Sequence
  source: /note="Description of Artificial Sequence: Synthetic peptide"
DGTIFGVVLGDY

SEQ ID NO: 1448 - protein, 12 aa, Artificial Sequence
  source: /note="Description of Artificial Sequence: Synthetic peptide"
DGTIFGVVLGDY

SEQ ID NO: 1449 - protein, 12 aa, Artificial Sequence
  source: /note="Description of Artificial Sequence: Synthetic peptide"
DGTIFGVVLGDY

SEQ ID NO: 1450 - protein, 12 aa, Artificial Sequence
  source: /note="Description of Artificial Sequence: Synthetic peptide"
DGTIFGVVLGDY

SEQ ID NO: 1451 - protein, 12 aa, Artificial Sequence
  source: /note="Description of Artificial Sequence: Synthetic peptide"
DRTIFGVVLGDY

SEQ ID NO: 1452 - protein, 12 aa, Artificial Sequence
  source: /note="Description of Artificial Sequence: Synthetic peptide"
DGTIFGVVLGDY

SEQ ID NO: 1453 - protein, 11 aa, Artificial Sequence
  source: /note="Description of Artificial Sequence: Synthetic peptide"
DRTIFGVVLDY

SEQ ID NO: 1454 - protein, 11 aa, Artificial Sequence
  source: /note="Description of Artificial Sequence: Synthetic peptide"
DRTIFGVVLDY

SEQ ID NO: 1455 - protein, 11 aa, Artificial Sequence
  source: /note="Description of Artificial Sequence: Synthetic peptide"
DRTIFGVVLDY

SEQ ID NO: 1456 - protein, 11 aa, Artificial Sequence
  source: /note="Description of Artificial Sequence: Synthetic peptide"
DRTIFGVVLDY

SEQ ID NO: 1457 - protein, 11 aa, Artificial Sequence
  source: /note="Description of Artificial Sequence: Synthetic peptide"
DRTIFGVVLDY

SEQ ID NO: 1458 - protein, 11 aa, Artificial Sequence
  source: /note="Description of Artificial Sequence: Synthetic peptide"
DRTIFGVVLDY

SEQ ID NO: 1459 - protein, 11 aa, Artificial Sequence
  source: /note="Description of Artificial Sequence: Synthetic peptide"
DRTIFGVVLDY

SEQ ID NO: 1460 - protein, 11 aa, Artificial Sequence
  source: /note="Description of Artificial Sequence: Synthetic peptide"
DRTIFGVVLDY

SEQ ID NO: 1461 - protein, 11 aa, Artificial Sequence
  source: /note="Description of Artificial Sequence: Synthetic peptide"
DRTIFGVVLDY

SEQ ID NO: 1462 - protein, 12 aa, Artificial Sequence
  source: /note="Description of Artificial Sequence: Synthetic peptide"
DGTIFGVLLGDY

SEQ ID NO: 1463 - protein, 12 aa, Artificial Sequence
  source: /note="Description of Artificial Sequence: Synthetic peptide"
DRTIFGVLLGDY

SEQ ID NO: 1464 - protein, 12 aa, Artificial Sequence
  source: /note="Description of Artificial Sequence: Synthetic peptide"
DGTIFGVLLGDY

SEQ ID NO: 1465 - protein, 12 aa, Artificial Sequence
  source: /note="Description of Artificial Sequence: Synthetic peptide"
DRTIFGVLLGDY

SEQ ID NO: 1466 - protein, 12 aa, Artificial Sequence
  source: /note="Description of Artificial Sequence: Synthetic peptide"
DGTIFGVLLGDY

SEQ ID NO: 1467 - protein, 12 aa, Artificial Sequence
  source: /note="Description of Artificial Sequence: Synthetic peptide"
DGTIFGVLLGDY

SEQ ID NO: 1468 - protein, 12 aa, Artificial Sequence
  source: /note="Description of Artificial Sequence: Synthetic peptide"
DGTIFGVLLGDY

SEQ ID NO: 1469 - protein, 11 aa, Artificial Sequence
  source: /note="Description of Artificial Sequence: Synthetic peptide"
DRTIFGVVLEY

SEQ ID NO: 1470 - protein, 11 aa, Artificial Sequence
  source: /note="Description of Artificial Sequence: Synthetic peptide"
DRTIFGVVLEY

SEQ ID NO: 1471 - protein, 11 aa, Artificial Sequence
  source: /note="Description of Artificial Sequence: Synthetic peptide"
DRTIFGVVLEY

SEQ ID NO: 1472 - protein, 11 aa, Artificial Sequence
  source: /note="Description of Artificial Sequence: Synthetic peptide"
DRTIFGVVLEY

SEQ ID NO: 1473 - protein, 11 aa, Artificial Sequence
  source: /note="Description of Artificial Sequence: Synthetic peptide"
DRTIFGVVLEY

SEQ ID NO: 1474 - protein, 11 aa, Artificial Sequence
  source: /note="Description of Artificial Sequence: Synthetic peptide"
DRTIFGVVLEY

SEQ ID NO: 1475 - protein, 11 aa, Artificial Sequence
  source: /note="Description of Artificial Sequence: Synthetic peptide"
DRTIFGVVLEY

SEQ ID NO: 1476 - protein, 11 aa, Artificial Sequence
  source: /note="Description of Artificial Sequence: Synthetic peptide"
DRTIFGVVLEY

SEQ ID NO: 1477 - protein, 11 aa, Artificial Sequence
  source: /note="Description of Artificial Sequence: Synthetic peptide"
DRTIFGVVLEY

SEQ ID NO: 1478 - protein, 11 aa, Artificial Sequence
  source: /note="Description of Artificial Sequence: Synthetic peptide"
DRTIFGVVLEY

SEQ ID NO: 1479 - protein, 11 aa, Artificial Sequence
  source: /note="Description of Artificial Sequence: Synthetic peptide"
DRTIFGVVLEY

SEQ ID NO: 1480 - protein, 11 aa, Artificial Sequence
  source: /note="Description of Artificial Sequence: Synthetic peptide"
GITIFGHGFEY

SEQ ID NO: 1481 - protein, 11 aa, Artificial Sequence
  source: /note="Description of Artificial Sequence: Synthetic peptide"
GITIFGHGFEY

SEQ ID NO: 1482 - protein, 11 aa, Artificial Sequence
  source: /note="Description of Artificial Sequence: Synthetic peptide"
GITIFGHGFEY

SEQ ID NO: 1483 - protein, 11 aa, Artificial Sequence
  source: /note="Description of Artificial Sequence: Synthetic peptide"
GITIFGHGFEY

SEQ ID NO: 1484 - protein, 11 aa, Artificial Sequence
  source: /note="Description of Artificial Sequence: Synthetic peptide"
DQAIFGVVPDY

SEQ ID NO: 1485 - protein, 11 aa, Artificial Sequence
  source: /note="Description of Artificial Sequence: Synthetic peptide"
DQAIFGVVPDY

SEQ ID NO: 1486 - protein, 11 aa, Artificial Sequence
  source: /note="Description of Artificial Sequence: Synthetic peptide"
DQAIFGVVPDY

SEQ ID NO: 1487 - protein, 11 aa, Artificial Sequence
  source: /note="Description of Artificial Sequence: Synthetic peptide"
DQAIFGVVPDY

SEQ ID NO: 1488 - protein, 11 aa, Artificial Sequence
  source: /note="Description of Artificial Sequence: Synthetic peptide"
DQAIFGVVPDY

SEQ ID NO: 1489 - protein, 11 aa, Artificial Sequence
  source: /note="Description of Artificial Sequence: Synthetic peptide"
DQAIFGVVPDY

SEQ ID NO: 1490 - protein, 11 aa, Artificial Sequence
  source: /note="Description of Artificial Sequence: Synthetic peptide"
DQAIFGVVPDY

SEQ ID NO: 1491 - protein, 11 aa, Artificial Sequence
  source: /note="Description of Artificial Sequence: Synthetic peptide"
DQAIFGVVPDY

SEQ ID NO: 1492 - protein, 16 aa, Artificial Sequence
  source: /note="Description of Artificial Sequence: Synthetic peptide"
DRITIFGVVMGGGMDV

SEQ ID NO: 1493 - protein, 16 aa, Artificial Sequence
  source: /note="Description of Artificial Sequence: Synthetic peptide"
DRITIFGVVMGGGMDV

SEQ ID NO: 1494 - protein, 16 aa, Artificial Sequence
  source: /note="Description of Artificial Sequence: Synthetic peptide"
DRITIFGVVMGGGMDV

SEQ ID NO: 1495 - protein, 16 aa, Artificial Sequence
  source: /note="Description of Artificial Sequence: Synthetic peptide"
DRITIFGVVMGGGMDV

SEQ ID NO: 1496 - protein, 16 aa, Artificial Sequence
  source: /note="Description of Artificial Sequence: Synthetic peptide"
DRITIFGVVMGGGMDV

SEQ ID NO: 1497 - protein, 16 aa, Artificial Sequence
  source: /note="Description of Artificial Sequence: Synthetic peptide"
DRITIFGVVMGGGMDV

SEQ ID NO: 1498 - protein, 16 aa, Artificial Sequence
  source: /note="Description of Artificial Sequence: Synthetic peptide"
DRITIFGVVMGGGMDV

SEQ ID NO: 1499 - protein, 14 aa, Artificial Sequence
  source: /note="Description of Artificial Sequence: Synthetic peptide"
EATIFGMVIVPFDY

SEQ ID NO: 1500 - protein, 14 aa, Artificial Sequence
  source: /note="Description of Artificial Sequence: Synthetic peptide"
EATIFGMVIVPFDY

SEQ ID NO: 1501 - protein, 14 aa, Artificial Sequence
  source: /note="Description of Artificial Sequence: Synthetic peptide"
EATIFGMVIVPFDY

SEQ ID NO: 1502 - protein, 14 aa, Artificial Sequence
  source: /note="Description of Artificial Sequence: Synthetic peptide"
EATIFGMVIVPFDY

SEQ ID NO: 1503 - protein, 14 aa, Artificial Sequence
  source: /note="Description of Artificial Sequence: Synthetic peptide"
EATIFGMVIVPFDY

SEQ ID NO: 1504 - protein, 14 aa, Artificial Sequence
  source: /note="Description of Artificial Sequence: Synthetic peptide"
EATIFGMVIVPFDY

SEQ ID NO: 1505 - protein, 14 aa, Artificial Sequence
  source: /note="Description of Artificial Sequence: Synthetic peptide"
EATIFGMVIVPFDY

SEQ ID NO: 1506 - protein, 14 aa, Artificial Sequence
  source: /note="Description of Artificial Sequence: Synthetic peptide"
EATIFGMVIVPFDY

SEQ ID NO: 1507 - protein, 14 aa, Artificial Sequence
  source: /note="Description of Artificial Sequence: Synthetic peptide"
EATIFGMVIVPFDY

SEQ ID NO: 1508 - protein, 14 aa, Artificial Sequence
  source: /note="Description of Artificial Sequence: Synthetic peptide"
EATIFGMVIVPFDY

SEQ ID NO: 1509 - protein, 14 aa, Artificial Sequence
  source: /note="Description of Artificial Sequence: Synthetic peptide"
EATIFGMVIVPFDY

SEQ ID NO: 1510 - protein, 14 aa, Artificial Sequence
  source: /note="Description of Artificial Sequence: Synthetic peptide"
EATIFGMLIVPFDY

SEQ ID NO: 1511 - protein, 14 aa, Artificial Sequence
  source: /note="Description of Artificial Sequence: Synthetic peptide"
EATIFGMLIVPFDY

SEQ ID NO: 1512 - protein, 14 aa, Artificial Sequence
  source: /note="Description of Artificial Sequence: Synthetic peptide"
EATIFGMLIVPFDY

SEQ ID NO: 1513 - protein, 14 aa, Artificial Sequence
  source: /note="Description of Artificial Sequence: Synthetic peptide"
EATIFGMLIVPFDY

SEQ ID NO: 1514 - protein, 14 aa, Artificial Sequence
  source: /note="Description of Artificial Sequence: Synthetic peptide"
EATIFGMLIVPFDY

SEQ ID NO: 1515 - protein, 14 aa, Artificial Sequence
  source: /note="Description of Artificial Sequence: Synthetic peptide"
EATIFGMLIVPFDY

SEQ ID NO: 1516 - protein, 14 aa, Artificial Sequence
  source: /note="Description of Artificial Sequence: Synthetic peptide"
EATIFGMLIVPFDY

SEQ ID NO: 1517 - protein, 14 aa, Artificial Sequence
  source: /note="Description of Artificial Sequence: Synthetic peptide"
EATIFGMLIVPFDY

SEQ ID NO: 1518 - protein, 14 aa, Artificial Sequence
  source: /note="Description of Artificial Sequence: Synthetic peptide"
EATIFGMLIVPFDY

SEQ ID NO: 1519 - protein, 14 aa, Artificial Sequence
  source: /note="Description of Artificial Sequence: Synthetic peptide"
EATIFGMVIVPFDY

SEQ ID NO: 1520 - protein, 14 aa, Artificial Sequence
  source: /note="Description of Artificial Sequence: Synthetic peptide"
EATIFGMVIVPFDY

SEQ ID NO: 1521 - protein, 14 aa, Artificial Sequence
  source: /note="Description of Artificial Sequence: Synthetic peptide"
EATIFGMVIVPFDY

SEQ ID NO: 1522 - protein, 14 aa, Artificial Sequence
  source: /note="Description of Artificial Sequence: Synthetic peptide"
EATIFGMVIVPFDY

SEQ ID NO: 1523 - protein, 14 aa, Artificial Sequence
  source: /note="Description of Artificial Sequence: Synthetic peptide"
EATIFGMVIVPFDY

SEQ ID NO: 1524 - protein, 14 aa, Artificial Sequence
  source: /note="Description of Artificial Sequence: Synthetic peptide"
EATIFGMLIVPFDY

SEQ ID NO: 1525 - protein, 14 aa, Artificial Sequence
  source: /note="Description of Artificial Sequence: Synthetic peptide"
EATIFGMLIVPFDY

SEQ ID NO: 1526 - protein, 14 aa, Artificial Sequence
  source: /note="Description of Artificial Sequence: Synthetic peptide"
EATIFGMLIVPFDY

SEQ ID NO: 1527 - protein, 14 aa, Artificial Sequence
  source: /note="Description of Artificial Sequence: Synthetic peptide"
EATIFGMLIVPFDY

SEQ ID NO: 1528 - protein, 14 aa, Artificial Sequence
  source: /note="Description of Artificial Sequence: Synthetic peptide"
EATIFGMLIVPFDY

SEQ ID NO: 1529 - protein, 14 aa, Artificial Sequence
  source: /note="Description of Artificial Sequence: Synthetic peptide"
EATIFGMLIVPFDY

SEQ ID NO: 1530 - protein, 14 aa, Artificial Sequence
  source: /note="Description of Artificial Sequence: Synthetic peptide"
EATIFGMLIVPFDY

SEQ ID NO: 1531 - protein, 14 aa, Artificial Sequence
  source: /note="Description of Artificial Sequence: Synthetic peptide"
EATIFGMLIVPFDY

SEQ ID NO: 1532 - protein, 14 aa, Artificial Sequence
  source: /note="Description of Artificial Sequence: Synthetic peptide"
EATIFGMLIVPFDY

SEQ ID NO: 1533 - protein, 14 aa, Artificial Sequence
  source: /note="Description of Artificial Sequence: Synthetic peptide"
EATIFGMLIVPFDY

SEQ ID NO: 1534 - protein, 14 aa, Artificial Sequence
  source: /note="Description of Artificial Sequence: Synthetic peptide"
EATIFGMLIVPFDY

SEQ ID NO: 1535 - protein, 14 aa, Artificial Sequence
  source: /note="Description of Artificial Sequence: Synthetic peptide"
EATIFGMLIVPFDY

SEQ ID NO: 1536 - protein, 14 aa, Artificial Sequence
  source: /note="Description of Artificial Sequence: Synthetic peptide"
EATIFGMLIVPFDY

SEQ ID NO: 1537 - protein, 19 aa, Artificial Sequence
  source: /note="Description of Artificial Sequence: Synthetic peptide"
GGDYVWGTYRPHYYYGMDV

SEQ ID NO: 1538 - protein, 19 aa, Artificial Sequence
  source: /note="Description of Artificial Sequence: Synthetic peptide"
GGDYVWGTYRPHYYYGMDV

SEQ ID NO: 1539 - protein, 19 aa, Artificial Sequence
  source: /note="Description of Artificial Sequence: Synthetic peptide"
GGDYVWGTYRPHYYYGMDV

SEQ ID NO: 1540 - protein, 19 aa, Artificial Sequence
  source: /note="Description of Artificial Sequence: Synthetic peptide"
GGDYVWGTYRPHYYYGMDV

SEQ ID NO: 1541 - protein, 19 aa, Artificial Sequence
  source: /note="Description of Artificial Sequence: Synthetic peptide"
GGDYVWGTYRPHYYYGMDV

SEQ ID NO: 1542 - protein, 19 aa, Artificial Sequence
  source: /note="Description of Artificial Sequence: Synthetic peptide"
GGDYVWGTYRPHYYYGMDV

SEQ ID NO: 1543 - protein, 19 aa, Artificial Sequence
  source: /note="Description of Artificial Sequence: Synthetic peptide"
GGDYVWGTYRPHYYYGMDV

SEQ ID NO: 1544 - protein, 19 aa, Artificial Sequence
  source: /note="Description of Artificial Sequence: Synthetic peptide"
GGDYVWGTYRPHYYYGMDV

SEQ ID NO: 1545 - protein, 19 aa, Artificial Sequence
  source: /note="Description of Artificial Sequence: Synthetic peptide"
GGDYVWGTYRPHYYYGMDV

SEQ ID NO: 1546 - protein, 19 aa, Artificial Sequence
  source: /note="Description of Artificial Sequence: Synthetic peptide"
GGDYVWGTYRPHYYYGMDV

SEQ ID NO: 1547 - protein, 19 aa, Artificial Sequence
  source: /note="Description of Artificial Sequence: Synthetic peptide"
GGDYVWGTYRPHYYYGMDV

SEQ ID NO: 1548 - protein, 19 aa, Artificial Sequence
  source: /note="Description of Artificial Sequence: Synthetic peptide"
GGDYVWGTYRPHYYYGMDV

SEQ ID NO: 1549 - protein, 19 aa, Artificial Sequence
  source: /note="Description of Artificial Sequence: Synthetic peptide"
GGDYVFGTYRPHYYYGMDV

SEQ ID NO: 1550 - protein, 19 aa, Artificial Sequence
  source: /note="Description of Artificial Sequence: Synthetic peptide"
GGDYVFGTYRPHYYYGMDV

SEQ ID NO: 1551 - protein, 12 aa, Artificial Sequence
  source: /note="Description of Artificial Sequence: Synthetic peptide"
DRTIFGVVLGDY

SEQ ID NO: 1552 - protein, 12 aa, Artificial Sequence
  source: /note="Description of Artificial Sequence: Synthetic peptide"
DRTIFGVLLGDY

SEQ ID NO: 1553 - protein, 19 aa, Artificial Sequence
  source: /note="Description of Artificial Sequence: Synthetic peptide"
GGDYVWGTYRPHYYYGMDV

SEQ ID NO: 1554 - protein, 12 aa, Artificial Sequence
  source: /note="Description of Artificial Sequence: Synthetic peptide"
GKVAGMPEAFEI

SEQ ID NO: 1555 - protein, 20 aa, Artificial Sequence
  source: /note="Description of Artificial Sequence: Synthetic peptide"
GGDYVWGSYRPYYYYYGMDV

SEQ ID NO: 1556 - protein, 12 aa, Artificial Sequence
  source: /note="Description of Artificial Sequence: Synthetic peptide"
GKVAGMPEAFEI

SEQ ID NO: 1557 - protein, 12 aa, Artificial Sequence
  source: /note="Description of Artificial Sequence: Synthetic peptide"
GKVAGMPEAFEI

SEQ ID NO: 1558 - protein, 12 aa, Artificial Sequence
  source: /note="Description of Artificial Sequence: Synthetic peptide"
GKVAGMPEAFEI

SEQ ID NO: 1559 - protein, 12 aa, Artificial Sequence
  source: /note="Description of Artificial Sequence: Synthetic peptide"
GKVAGMPEAFEI

SEQ ID NO: 1560 - protein, 12 aa, Artificial Sequence
  source: /note="Description of Artificial Sequence: Synthetic peptide"
GKVAGMPEAFEI

SEQ ID NO: 1561 - protein, 12 aa, Artificial Sequence
  source: /note="Description of Artificial Sequence: Synthetic peptide"
GKVAGMPEAFEI

SEQ ID NO: 1562 - protein, 20 aa, Artificial Sequence
  source: /note="Description of Artificial Sequence: Synthetic peptide"
GGDYVWGSYRPYYYYYGMDV

SEQ ID NO: 1563 - protein, 20 aa, Artificial Sequence
  source: /note="Description of Artificial Sequence: Synthetic peptide"
GGDYVWGSYRPYYYYYGMDV

SEQ ID NO: 1564 - protein, 20 aa, Artificial Sequence
  source: /note="Description of Artificial Sequence: Synthetic peptide"
GGDYVWGSYRPYYYYYGMDV

SEQ ID NO: 1565 - protein, 20 aa, Artificial Sequence
  source: /note="Description of Artificial Sequence: Synthetic peptide"
GGDYVWGSYRPYYYYYGMDV

SEQ ID NO: 1566 - protein, 20 aa, Artificial Sequence
  source: /note="Description of Artificial Sequence: Synthetic peptide"
GGDYVWGSYRPYYYYYGMDV

SEQ ID NO: 1567 - protein, 20 aa, Artificial Sequence
  source: /note="Description of Artificial Sequence: Synthetic peptide"
GGDYVWGSYRPYYYYYGMDV

SEQ ID NO: 1568 - protein, 20 aa, Artificial Sequence
  source: /note="Description of Artificial Sequence: Synthetic peptide"
GGDYVFGSYRPYYYYYGMDV

SEQ ID NO: 1569 - protein, 20 aa, Artificial Sequence
  source: /note="Description of Artificial Sequence: Synthetic peptide"
GGDYVFGSYRPYYYYYGMDV

SEQ ID NO: 1570 - protein, 12 aa, Artificial Sequence
  source: /note="Description of Artificial Sequence: Synthetic peptide"
GKVAGMPEAFEI

SEQ ID NO: 1571 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1572 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1573 - DNA, 324 bp, Artificial Sequence; identical to SEQ ID NO: 1572
  source: /note="Description of Artificial Sequence: Synthetic polynucleotide"

SEQ ID NO: 1574 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagatattgcaacatattactgtcaacagtatgatattctcctcactttcggcggagggaccaaggtggagatcaagcga

SEQ ID NO: 1575 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagcaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1576 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagaaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1577 - DNA, 342 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1578 - DNA, 342 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1579 - DNA, 327 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagacaggagcctgatgattttgcagtgtattactgtcagcagtatggtagttcaccgctcactttcggcggagggaccaaggtggagatcaaacga

SEQ ID NO: 1580 - DNA, 324 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacga

SEQ ID NO: 1581 - DNA, 324 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacga

SEQ ID NO: 1582 - DNA, 321 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagatattgcaacatattactgtcaacagtatgatgatctattcactttcggccctgggaccaaagtggatatcaaacga

SEQ ID NO: 1583 - DNA, 324 bp, Artificial Sequence
  source: /note="Description of Artificial Sequence: Synthetic polynucleotide"
gacatccagatgacccagtctccatcttccgtgtctgcatctgtaggagacagagtcaccatcacttgtcgggcgagtcagggtcttatcatctggttagcctggtatcagcagaaaccggggaaagcccctaaactcctgatctatgctgcatccagtttgcaaagtggggtcccatcaaggttcagcggcagtggctctgggacagatttcactctcaccatcagcagcctacagcctgaagattttgcaacttactattgtcaacagactaacagtttccctccgacgttcggccaagggaccaaggtggaaatcaaacga

SEQ ID NO: 1584 - DNA, 324 bp, Artificial Sequence; identical to SEQ ID NO: 1583
  source: /note="Description of Artificial Sequence: Synthetic polynucleotide"

SEQ ID NO: 1585 - DNA, 324 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacga

SEQ ID NO: 1586 - DNA, 324 bp, Artificial Sequence; identical to SEQ ID NO: 1585
  source: /note="Description of Artificial Sequence: Synthetic polynucleotide"

SEQ ID NO: 1587 - DNA, 324 bp, Artificial Sequence; identical to SEQ ID NO: 1585
  source: /note="Description of Artificial Sequence: Synthetic polynucleotide"

SEQ ID NO: 1588 - DNA, 324 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacga

SEQ ID NO: 1589 - DNA, 324 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacga

SEQ ID NO: 1590 - DNA, 324 bp, Artificial Sequence; identical to SEQ ID NO: 1585
  source: /note="Description of Artificial Sequence: Synthetic polynucleotide"

SEQ ID NO: 1591 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1592 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1593 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1594 - DNA, 324 bp, Artificial Sequence; identical to SEQ ID NO: 1591
  source: /note="Description of Artificial Sequence: Synthetic polynucleotide"

SEQ ID NO: 1595 - DNA, 324 bp, Artificial Sequence; identical to SEQ ID NO: 1591
  source: /note="Description of Artificial Sequence: Synthetic polynucleotide"

SEQ ID NO: 1596 - DNA, 324 bp, Artificial Sequence; identical to SEQ ID NO: 1591
  source: /note="Description of Artificial Sequence: Synthetic polynucleotide"

SEQ ID NO: 1597 - DNA, 324 bp, Artificial Sequence; identical to SEQ ID NO: 1591
  source: /note="Description of Artificial Sequence: Synthetic polynucleotide"

SEQ ID NO: 1598 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaccagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1599 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1600 - DNA, 324 bp, Artificial Sequence; identical to SEQ ID NO: 1599
  source: /note="Description of Artificial Sequence: Synthetic polynucleotide"

SEQ ID NO: 1601 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaccagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1602 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacga

SEQ ID NO: 1603 - DNA, 324 bp, Artificial Sequence; identical to SEQ ID NO: 1602
  source: /note="Description of Artificial Sequence: Synthetic polynucleotide"

SEQ ID NO: 1604 - DNA, 324 bp, Artificial Sequence; identical to SEQ ID NO: 1601
  source: /note="Description of Artificial Sequence: Synthetic polynucleotide"

SEQ ID NO: 1605 - DNA, 324 bp, Artificial Sequence; identical to SEQ ID NO: 1598
  source: /note="Description of Artificial Sequence: Synthetic polynucleotide"

SEQ ID NO: 1606 - DNA, 324 bp, Artificial Sequence; identical to SEQ ID NO: 1599
  source: /note="Description of Artificial Sequence: Synthetic polynucleotide"

SEQ ID NO: 1607 - DNA, 324 bp, Artificial Sequence; identical to SEQ ID NO: 1599
  source: /note="Description of Artificial Sequence: Synthetic polynucleotide"

SEQ ID NO: 1608 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1609 - DNA, 324 bp, Artificial Sequence; identical to SEQ ID NO: 1599
  source: /note="Description of Artificial Sequence: Synthetic polynucleotide"

SEQ ID NO: 1610 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagattttgcaacatattactgtcaacagtatgatattctcctcactttcggcggagggaccaaggtggagatcaagcga

SEQ ID NO: 1611 - DNA, 321 bp, Artificial Sequence; identical to SEQ ID NO: 1610
  source: /note="Description of Artificial Sequence: Synthetic polynucleotide"

SEQ ID NO: 1612 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagatattgcaacatattactgtcaacagtatgatattctcctcactttcggcggagggaccaaggtggagatcaagcga

SEQ ID NO: 1613 - DNA, 321 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagattttgcaacatattactgtcaacagtatgatattctcctcactttcggcggagggaccaaggtggagatcaagcga

SEQ ID NO: 1614 - DNA, 321 bp, Artificial Sequence; identical to SEQ ID NO: 1612
  source: /note="Description of Artificial Sequence: Synthetic polynucleotide"

SEQ ID NO: 1615 - DNA, 321 bp, Artificial Sequence; identical to SEQ ID NO: 1613
  source: /note="Description of Artificial Sequence: Synthetic polynucleotide"

SEQ ID NO: 1616 - DNA, 321 bp, Artificial Sequence; identical to SEQ ID NO: 1574
  source: /note="Description of Artificial Sequence: Synthetic polynucleotide"

SEQ ID NO: 1617 - DNA, 321 bp, Artificial Sequence; identical to SEQ ID NO: 1610
  source: /note="Description of Artificial Sequence: Synthetic polynucleotide"

SEQ ID NO: 1618 - DNA, 321 bp, Artificial Sequence; identical to SEQ ID NO: 1610
  source: /note="Description of Artificial Sequence: Synthetic polynucleotide"

SEQ ID NO: 1619 - DNA, 324 bp, Artificial Sequence; identical to SEQ ID NO: 1572
  source: /note="Description of Artificial Sequence: Synthetic polynucleotide"

SEQ ID NO: 1620 - DNA, 324 bp, Artificial Sequence; identical to SEQ ID NO: 1572
  source: /note="Description of Artificial Sequence: Synthetic polynucleotide"

SEQ ID NO: 1621 - DNA, 324 bp, Artificial Sequence; identical to SEQ ID NO: 1591
  source: /note="Description of Artificial Sequence: Synthetic polynucleotide"

SEQ ID NO: 1622 - DNA, 324 bp, Artificial Sequence; identical to SEQ ID NO: 1591
  source: /note="Description of Artificial Sequence: Synthetic polynucleotide"

SEQ ID NO: 1623 - DNA, 324 bp, Artificial Sequence; identical to SEQ ID NO: 1593
  source: /note="Description of Artificial Sequence: Synthetic polynucleotide"

SEQ ID NO: 1624 - DNA, 324 bp, Artificial Sequence; identical to SEQ ID NO: 1593
  source: /note="Description of Artificial Sequence: Synthetic polynucleotide"

SEQ ID NO: 1625 - DNA, 324 bp, Artificial Sequence; identical to SEQ ID NO: 1593
  source: /note="Description of Artificial Sequence: Synthetic polynucleotide"

SEQ ID NO: 1626 - DNA, 321 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccctgggaccaaagtggatatcaaacga

SEQ ID NO: 1627 - DNA, 321 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagatattgcaacatattactgtcaacagtatgatgatctattcactttcggccctgggaccaaagtggatatcaaacga

SEQ ID NO: 1628 - DNA, 321 bp, Artificial Sequence; identical to SEQ ID NO: 1626
  source: /note="Description of Artificial Sequence: Synthetic polynucleotide"

SEQ ID NO: 1629 - DNA, 321 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagattttgcaacatattactgtcaacagtatgatgatctattcactttcggccctgggaccaaagtggatatcaaacga

SEQ ID NO: 1630 - DNA, 321 bp, Artificial Sequence; identical to SEQ ID NO: 1627
  source: /note="Description of Artificial Sequence: Synthetic polynucleotide"

SEQ ID NO: 1631 - DNA, 321 bp, Artificial Sequence; identical to SEQ ID NO: 1629
  source: /note="Description of Artificial Sequence: Synthetic polynucleotide"

SEQ ID NO: 1632 - DNA, 321 bp, Artificial Sequence; identical to SEQ ID NO: 1582
  source: /note="Description of Artificial Sequence: Synthetic polynucleotide"

SEQ ID NO: 1633 - DNA, 321 bp, Artificial Sequence; identical to SEQ ID NO: 1626
  source: /note="Description of Artificial Sequence: Synthetic polynucleotide"

SEQ ID NO: 1634 - DNA, 321 bp, Artificial Sequence; identical to SEQ ID NO: 1626
  source: /note="Description of Artificial Sequence: Synthetic polynucleotide"

SEQ ID NO: 1635 - DNA, 321 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccaagggaccaaagtggatatcaaacga

SEQ ID NO: 1636 - DNA, 321 bp, Artificial Sequence; identical to SEQ ID NO: 1635
  source: /note="Description of Artificial Sequence: Synthetic polynucleotide"

SEQ ID NO: 1637 - DNA, 324 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagatttttaccagcacctacttagcctggtaccagcagaaacctggccaggctcccaggctcctcatctatggtgcatccagcagggccactggcatcccagacaggttcagtggcagtgggtctgggacagacttcactctcaccatcagcagattggagcctgaagattttgcagtgtattactgtcagcagtatggtagctcacctcgcttcggccaagggacacgactggagattaaacga

SEQ ID NO: 1638 - DNA, 324 bp, Artificial Sequence; identical to SEQ ID NO: 1637
  source: /note="Description of Artificial Sequence: Synthetic polynucleotide"

SEQ ID NO: 1639 - DNA, 324 bp, Artificial Sequence; identical to SEQ ID NO: 1637
  source: /note="Description of Artificial Sequence: Synthetic polynucleotide"

SEQ ID NO: 1640 - DNA, 324 bp, Artificial Sequence; identical to SEQ ID NO: 1637
  source: /note="Description of Artificial Sequence: Synthetic polynucleotide"

SEQ ID NO: 1641 - DNA, 324 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacga

SEQ ID NO: 1642 - DNA, 324 bp, Artificial Sequence; identical to SEQ ID NO: 1641
  source: /note="Description of Artificial Sequence: Synthetic polynucleotide"

SEQ ID NO: 1643 - DNA, 324 bp, Artificial Sequence; identical to SEQ ID NO: 1641
  source: /note="Description of Artificial Sequence: Synthetic polynucleotide"

SEQ ID NO: 1644 - DNA, 324 bp, Artificial Sequence; identical to SEQ ID NO: 1580
  source: /note="Description of Artificial Sequence: Synthetic polynucleotide"

SEQ ID NO: 1645 - DNA, 324 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataacttccctctcactttcggcggagggaccaaggtggagatcaaacga

SEQ ID NO: 1646 - DNA, 324 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactatcctctcactttcggcggagggaccaaggtggagatcaaacga

SEQ ID NO: 1647 - DNA, 324 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactggcctctcactttcggcggagggaccaaggtggagatcaaacga

SEQ ID NO: 1648 - DNA, 324 bp, Artificial Sequence; identical to SEQ ID NO: 1647
  source: /note="Description of Artificial Sequence: Synthetic polynucleotide"

SEQ ID NO: 1649 - DNA, 327 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagactggagcctgatgattttgcagtgtattactgtcagcagtatggtagttcaccgctcactttcggcggagggaccaaggtggagatcaaacga

SEQ ID NO: 1650 - DNA, 327 bp, Artificial Sequence; identical to SEQ ID NO: 1579
  source: /note="Description of Artificial Sequence: Synthetic polynucleotide"

SEQ ID NO: 1651 - DNA, 327 bp, Artificial Sequence; identical to SEQ ID NO: 1649
  source: /note="Description of Artificial Sequence: Synthetic polynucleotide"

SEQ ID NO: 1652 - DNA, 327 bp, Artificial Sequence; identical to SEQ ID NO: 1649
  source: /note="Description of Artificial Sequence: Synthetic polynucleotide"

SEQ ID NO: 1653 - DNA, 327 bp, Artificial Sequence; identical to SEQ ID NO: 1649
  source: /note="Description of Artificial Sequence: Synthetic polynucleotide"

SEQ ID NO: 1654 - DNA, 327 bp, Artificial Sequence; identical to SEQ ID NO: 1579
  source: /note="Description of Artificial Sequence: Synthetic polynucleotide"

SEQ ID NO: 1655 - DNA, 327 bp, Artificial Sequence; identical to SEQ ID NO: 1579
  source: /note="Description of Artificial Sequence: Synthetic polynucleotide"

SEQ ID NO: 1656 - DNA, 342 bp, Artificial Sequence; identical to SEQ ID NO: 1575
  source: /note="Description of Artificial Sequence: Synthetic polynucleotide"

SEQ ID NO: 1657 - DNA, 342 bp, Artificial Sequence; identical to SEQ ID NO: 1575
  source: /note="Description of Artificial Sequence: Synthetic polynucleotide"

SEQ ID NO: 1658 - DNA, 342 bp, Artificial Sequence; identical to SEQ ID NO: 1575
  source: /note="Description of Artificial Sequence: Synthetic polynucleotide"

SEQ ID NO: 1659 - DNA, 342 bp, Artificial Sequence; identical to SEQ ID NO: 1575
  source: /note="Description of Artificial Sequence: Synthetic polynucleotide"

SEQ ID NO: 1660 - DNA, 342 bp, Artificial Sequence; identical to SEQ ID NO: 1575
  source: /note="Description of Artificial Sequence: Synthetic polynucleotide"

SEQ ID NO: 1661 - DNA, 342 bp, Artificial Sequence; identical to SEQ ID NO: 1575
  source: /note="Description of Artificial Sequence: Synthetic polynucleotide"

SEQ ID NO: 1662 - DNA, 342 bp, Artificial Sequence; identical to SEQ ID NO: 1575
  source: /note="Description of Artificial Sequence: Synthetic polynucleotide"

SEQ ID NO: 1663 - DNA, 342 bp, Artificial Sequence; identical to SEQ ID NO: 1575
  source: /note="Description of Artificial Sequence: Synthetic polynucleotide"

SEQ ID NO: 1664 - DNA, 342 bp, Artificial Sequence; identical to SEQ ID NO: 1575
  source: /note="Description of Artificial Sequence: Synthetic polynucleotide"

SEQ ID NO: 1665 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagaaaccaggacaacctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacga

SEQ ID NO: 1666 - DNA, 342 bp, Artificial Sequence; identical to SEQ ID NO: 1665
  source: /note="Description of Artificial Sequence: Synthetic polynucleotide"

SEQ ID NO: 1667 - DNA, 342 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1668 - DNA, 342 bp, Artificial Sequence; identical to SEQ ID NO: 1667
  source: /note="Description of Artificial Sequence: Synthetic polynucleotide"

SEQ ID NO: 1669 - DNA, 342 bp, Artificial Sequence; identical to SEQ ID NO: 1577
  source: /note="Description of Artificial Sequence: Synthetic polynucleotide"

SEQ ID NO: 1670 - DNA, 342 bp, Artificial Sequence; identical to SEQ ID NO: 1667
  source: /note="Description of Artificial Sequence: Synthetic polynucleotide"

SEQ ID NO: 1671 - DNA, 342 bp, Artificial Sequence; identical to SEQ ID NO: 1667
  source: /note="Description of Artificial Sequence: Synthetic polynucleotide"

SEQ ID NO: 1672 - DNA, 342 bp, Artificial Sequence; identical to SEQ ID NO: 1577
  source: /note="Description of Artificial Sequence: Synthetic polynucleotide"

SEQ ID NO: 1673 - DNA, 342 bp, Artificial Sequence; identical to SEQ ID NO: 1577
  source: /note="Description of Artificial Sequence: Synthetic polynucleotide"

SEQ ID NO: 1674 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccaacagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1675 - DNA, 342 bp, Artificial Sequence; identical to SEQ ID NO: 1667
  source: /note="Description of Artificial Sequence: Synthetic polynucleotide"

SEQ ID NO: 1676 - DNA, 342 bp, Artificial Sequence; identical to SEQ ID NO: 1576
  source: /note="Description of Artificial Sequence: Synthetic polynucleotide"

SEQ ID NO: 1677 - DNA, 342 bp, Artificial Sequence; identical to SEQ ID NO: 1576
  source: /note="Description of Artificial Sequence: Synthetic polynucleotide"

SEQ ID NO: 1678 - DNA, 342 bp, Artificial Sequence; identical to SEQ ID NO: 1576
  source: /note="Description of Artificial Sequence: Synthetic polynucleotide"

SEQ ID NO: 1679 - DNA, 342 bp, Artificial Sequence; identical to SEQ ID NO: 1665
  source: /note="Description of Artificial Sequence: Synthetic polynucleotide"

SEQ ID NO: 1680 - DNA, 342 bp, Artificial Sequence; identical to SEQ ID NO: 1665
  source: /note="Description of Artificial Sequence: Synthetic polynucleotide"

SEQ ID NO: 1681 - DNA, 342 bp, Artificial Sequence; identical to SEQ ID NO: 1578
  source: /note="Description of Artificial Sequence: Synthetic polynucleotide"

SEQ ID NO: 1682 - DNA, 342 bp, Artificial Sequence; identical to SEQ ID NO: 1578
  source: /note="Description of Artificial Sequence: Synthetic polynucleotide"

SEQ ID NO: 1683 - DNA, 342 bp, Artificial Sequence; identical to SEQ ID NO: 1578
  source: /note="Description of Artificial Sequence: Synthetic polynucleotide"

SEQ ID NO: 1684 - DNA, 342 bp, Artificial Sequence; identical to SEQ ID NO: 1578
  source: /note="Description of Artificial Sequence: Synthetic polynucleotide"

SEQ ID NO: 1685 - DNA, 342 bp, Artificial Sequence; identical to SEQ ID NO: 1578
  source: /note="Description of Artificial Sequence: Synthetic polynucleotide"

SEQ ID NO: 1686 - DNA, 342 bp, Artificial Sequence; identical to SEQ ID NO: 1578
  source: /note="Description of Artificial Sequence: Synthetic polynucleotide"

SEQ ID NO: 1687 - DNA, 342 bp, Artificial Sequence; identical to SEQ ID NO: 1578
  source: /note="Description of Artificial Sequence: Synthetic polynucleotide"

SEQ ID NO: 1688 - DNA, 342 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1689 - DNA, 342 bp, Artificial Sequence; identical to SEQ ID NO: 1688
  source: /note="Description of Artificial Sequence: Synthetic polynucleotide"

SEQ ID NO: 1690 - DNA, 342 bp, Artificial Sequence; identical to SEQ ID NO: 1688
  source: /note="Description of Artificial Sequence: Synthetic polynucleotide"

SEQ ID NO: 1691 - DNA, 342 bp, Artificial Sequence; identical to SEQ ID NO: 1688
  source: /note="Description of Artificial Sequence: Synthetic polynucleotide"

SEQ ID NO: 1692 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1693 - DNA, 342 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacga

SEQ ID NO: 1694 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggt

SEQ ID NO: 1695 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggt

SEQ ID NO: 1696 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggt

SEQ ID NO: 1697 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggt

SEQ ID NO: 1698 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1699 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggt

SEQ ID NO: 1700 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgaatggtccggtattcggcggagggaccaagctgaccgtcctaggt

SEQ ID NO: 1701 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgcaaggtccggtattcggcggagggaccaagctgaccgtcctaggt

SEQ ID NO: 1702 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgagtggtccggtattcggcggagggaccaagctgaccgtcctaggt

SEQ ID NO: 1703 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatgctccggtattcggcggagggaccaagctgaccgtcctaggt

SEQ ID NO: 1704 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatggtccggtattcggcggagggaccaagctgaccgtcctaggt

SEQ ID NO: 1705 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatgctccggtattcggcggagggaccaagctgaccgtcctaggt

SEQ ID NO: 1706 - DNA, 333 bp, Artificial Sequence; identical to SEQ ID NO: 1705
  source: /note="Description of Artificial Sequence: Synthetic polynucleotide"

SEQ ID NO: 1707 - DNA, 333 bp, Artificial Sequence; identical to SEQ ID NO: 1694
  source: /note="Description of Artificial Sequence: Synthetic polynucleotide"

SEQ ID NO: 1708 - DNA, 324 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacga

SEQ ID NO: 1709 - DNA, 324 bp, Artificial Sequence; identical to SEQ ID NO: 1592
  source: /note="Description of Artificial Sequence: Synthetic polynucleotide"

SEQ ID NO: 1710 - DNA, 333 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcaactcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgagtggtccggtattcggcggagggaccaagctgaccgtcctaggt

SEQ ID NO: 1711 - DNA, 324 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcacacga

SEQ ID NO: 1712 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatgagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggt

SEQ ID NO: 1713 - DNA, 324 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacga

SEQ ID NO: 1714 - DNA, 324 bp, Artificial Sequence; identical to SEQ ID NO: 1713
  source: /note="Description of Artificial Sequence: Synthetic polynucleotide"

SEQ ID NO: 1715 - DNA, 324 bp, Artificial Sequence; identical to SEQ ID NO: 1711
  source: /note="Description of Artificial Sequence: Synthetic polynucleotide"

SEQ ID NO: 1716 - DNA, 324 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacga

SEQ ID NO: 1717 - DNA, 324 bp, Artificial Sequence; identical to SEQ ID NO: 1713
  source: /note="Description of Artificial Sequence: Synthetic polynucleotide"

SEQ ID NO: 1718 - DNA, 324 bp, Artificial Sequence; identical to SEQ ID NO: 1713
  source: /note="Description of Artificial Sequence: Synthetic polynucleotide"

SEQ ID NO: 1719 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggt

SEQ ID NO: 1720 - DNA, 333 bp, Artificial Sequence; identical to SEQ ID NO: 1719
  source: /note="Description of Artificial Sequence: Synthetic polynucleotide"

SEQ ID NO: 1721 - DNA, 333 bp, Artificial Sequence; identical to SEQ ID NO: 1712
  source: /note="Description of Artificial Sequence: Synthetic polynucleotide"

SEQ ID NO: 1722 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacattcgaaagcagcctgagtgctgtggtattcggcggagggaccaaactgaccgtcctaggt

SEQ ID NO: 1723 - DNA, 333 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagcagcctgagtgctgtggtattcggcggagggaccaaactgaccgtcctaggt

SEQ ID NO: 1724 - DNA, 333 bp, Artificial Sequence; identical to SEQ ID NO: 1723
  source: /note="Description of Artificial Sequence: Synthetic polynucleotide"

SEQ ID NO: 1725 - DNA, 333 bp, Artificial Sequence; identical to SEQ ID NO: 1719
  source: /note="Description of Artificial Sequence: Synthetic polynucleotide"

SEQ ID NO: 1726 - DNA, 333 bp, Artificial Sequence; identical to SEQ ID NO: 1722
  source: /note="Description of Artificial Sequence: Synthetic polynucleotide"

SEQ ID NO: 1727 - DNA, 324 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgctcagttttggccaggggaccaagctggagatcaaacga

SEQ ID NO: 1728 - DNA, 384 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgtttgggggacttatcggcctcactactactacggtatggacgtctggggccaagggaccacggtcaccgtctcctca

SEQ ID NO: 1729 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1730 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1731 - DNA, 360 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1732 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1733 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1734 - DNA, 369 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctca

SEQ ID NO: 1735 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1736 - DNA, 378 bp, Artificial Sequence
  source: /note="Description of Artificial Sequence: Synthetic polynucleotide"
caggtgcagttgcaggagtcgggcccaggactggtgaagccttcacagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1737 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1738 - DNA, 363 bp, Artificial Sequence; identical to SEQ ID NO: 1730
  source: /note="Description of Artificial Sequence: Synthetic polynucleotide"

SEQ ID NO: 1739 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctca

SEQ ID NO: 1740 - DNA, 351 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctcagggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctca

SEQ ID NO: 1741 - DNA, 351 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctgggggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctca

SEQ ID NO: 1742 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1743 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1744 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctca

SEQ ID NO: 1745 - DNA, 363 bp, Artificial Sequence; identical to SEQ ID NO: 1742
  source: /note="Description of Artificial Sequence: Synthetic polynucleotide"

SEQ ID NO: 1746 - DNA, 363 bp, Artificial Sequence; identical to SEQ ID NO: 1742
  source: /note="Description of Artificial Sequence: Synthetic polynucleotide"

SEQ ID NO: 1747 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagataggacgatttttggagtgctcttgggggactactggggccagggaaccctggtcaccgtctcctca

SEQ ID NO: 1748 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgcggacacggctgtgtattattgtgcgcgagatgggacgatctttggagtggtcttgggggactactggggccagggaaccctggtcaccgtctcctca

SEQ ID NO: 1749 - DNA, 363 bp, Artificial Sequence; identical to SEQ ID NO: 1748
  source: /note="Description of Artificial Sequence: Synthetic polynucleotide"

SEQ ID NO: 1750 - DNA, 363 bp, Artificial Sequence; identical to SEQ ID NO: 1748
  source: /note="Description of Artificial Sequence: Synthetic polynucleotide"

SEQ ID NO: 1751 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1752 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagacgccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctca

SEQ ID NO: 1753 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagataggacgatctttggagtggtcttgggggactactggggccagggaaccctggtcaccgtctcctca

SEQ ID NO: 1754 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagatgggacgatctttggagtggtcttgggggactactggggccagggaaccctggtcaccgtctcctca

SEQ ID NO: 1755 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagactccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctca

SEQ ID NO: 1756 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1757 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctca

SEQ ID NO: 1758 - DNA, 363 bp, Artificial Sequence; identical to SEQ ID NO: 1756
  source: /note="Description of Artificial Sequence: Synthetic polynucleotide"

SEQ ID NO: 1759 - DNA, 363 bp, Artificial Sequence; identical to SEQ ID NO: 1756
  source: /note="Description of Artificial Sequence: Synthetic polynucleotide"

SEQ ID NO: 1760 - DNA, 363 bp, Artificial Sequence; identical to SEQ ID NO: 1757
  source: /note="Description of Artificial Sequence: Synthetic polynucleotide"

SEQ ID NO: 1761 - DNA, 363 bp, Artificial Sequence; identical to SEQ ID NO: 1757
  source: /note="Description of Artificial Sequence: Synthetic polynucleotide"

SEQ ID NO: 1762 - DNA, 363 bp, Artificial Sequence; identical to SEQ ID NO: 1756
  source: /note="Description of Artificial Sequence: Synthetic polynucleotide"

SEQ ID NO: 1763 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1764 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagactccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctca

SEQ ID NO: 1765 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagataggacgatctttggagtggtcttgggggactactggggccagggaaccctggtcaccgtctcctca

SEQ ID NO: 1766 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagatgggacgatctttggagtggtcttgggggactactggggccagggaaccctggtcaccgtctcctca

SEQ ID NO: 1767 - DNA, 360 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1768 - DNA, 360 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1769 - DNA, 360 bp, Artificial Sequence; identical to SEQ ID NO: 1767
  source: /note="Description of Artificial Sequence: Synthetic polynucleotide"

SEQ ID NO: 1770 - DNA, 360 bp, Artificial Sequence; identical to SEQ ID NO: 1767
  source: /note="Description of Artificial Sequence: Synthetic polynucleotide"

SEQ ID NO: 1771 - DNA, 360 bp, Artificial Sequence; identical to SEQ ID NO: 1768
  source: /note="Description of Artificial Sequence: Synthetic polynucleotide"

SEQ ID NO: 1772 - DNA, 360 bp, Artificial Sequence; identical to SEQ ID NO: 1768
  source: /note="Description of Artificial Sequence: Synthetic polynucleotide"

SEQ ID NO: 1773 - DNA, 360 bp, Artificial Sequence; identical to SEQ ID NO: 1767
  source: /note="Description of Artificial Sequence: Synthetic polynucleotide"

SEQ ID NO: 1774 - DNA, 360 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagactccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1775 - DNA, 360 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctca

SEQ ID NO: 1776 - DNA, 363 bp, Artificial Sequence; identical to SEQ ID NO: 1742
  source: /note="Description of Artificial Sequence: Synthetic polynucleotide"

SEQ ID NO: 1777 - DNA, 363 bp, Artificial Sequence; identical to SEQ ID NO: 1747
  source: /note="Description of Artificial Sequence: Synthetic polynucleotide"

SEQ ID NO: 1778 - DNA, 363 bp, Artificial Sequence; identical to SEQ ID NO: 1742
  source: /note="Description of Artificial Sequence: Synthetic polynucleotide"

SEQ ID NO: 1779 - DNA, 363 bp, Artificial Sequence; identical to SEQ ID NO: 1747
  source: /note="Description of Artificial Sequence: Synthetic polynucleotide"

SEQ ID NO: 1780 - DNA, 363 bp, Artificial Sequence; identical to SEQ ID NO: 1730
  source: /note="Description of Artificial Sequence: Synthetic polynucleotide"

SEQ ID NO: 1781 - DNA, 363 bp, Artificial Sequence; identical to SEQ ID NO: 1743
  source: /note="Description of Artificial Sequence: Synthetic polynucleotide"

SEQ ID NO: 1782 - DNA, 363 bp, Artificial Sequence; identical to SEQ ID NO: 1744
  source: /note="Description of Artificial Sequence: Synthetic polynucleotide"

SEQ ID NO: 1783 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1784 - DNA, 360 bp, Artificial Sequence; identical to SEQ ID NO: 1783
  source: /note="Description of Artificial Sequence: Synthetic polynucleotide"

SEQ ID NO: 1785 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctca

SEQ ID NO: 1786 - DNA, 360 bp, Artificial Sequence; identical to SEQ ID NO: 1783
  source: /note="Description of Artificial Sequence: Synthetic polynucleotide"

SEQ ID NO: 1787 - DNA, 360 bp, Artificial Sequence; identical to SEQ ID NO: 1785
  source: /note="Description of Artificial Sequence: Synthetic polynucleotide"

SEQ ID NO: 1788 - DNA, 360 bp, Artificial Sequence; identical to SEQ ID NO: 1785
  source: /note="Description of Artificial Sequence: Synthetic polynucleotide"

SEQ ID NO: 1789 - DNA, 360 bp, Artificial Sequence; identical to SEQ ID NO: 1783
  source: /note="Description of Artificial Sequence: Synthetic polynucleotide"

SEQ ID NO: 1790 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1791 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctca

SEQ ID NO: 1792 - DNA, 360 bp, Artificial Sequence; identical to SEQ ID NO: 1783
  source: /note="Description of Artificial Sequence: Synthetic polynucleotide"

SEQ ID NO: 1793 - DNA, 360 bp, Artificial Sequence; identical to SEQ ID NO: 1785
  source: /note="Description of Artificial Sequence: Synthetic polynucleotide"

SEQ ID NO: 1794 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1795 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1796 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1797 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctca

SEQ ID NO: 1798 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1799 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1800 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1801 - DNA, 360 bp, Artificial Sequence; identical to SEQ ID NO: 1798
  source: /note="Description of Artificial Sequence: Synthetic polynucleotide"

SEQ ID NO: 1802 - DNA, 360 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcaaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctca

SEQ ID NO: 1803 - DNA, 360 bp, Artificial Sequence; identical to SEQ ID NO: 1802
  source: /note="Description of Artificial Sequence: Synthetic polynucleotide"

SEQ ID NO: 1804 - DNA, 360 bp, Artificial Sequence; identical to SEQ ID NO: 1798
  source: /note="Description of Artificial Sequence: Synthetic polynucleotide"

SEQ ID NO: 1805 - DNA, 360 bp, Artificial Sequence; identical to SEQ ID NO: 1802
  source: /note="Description of Artificial Sequence: Synthetic polynucleotide"

SEQ ID NO: 1806 - DNA, 378 bp, Artificial Sequence
  source: /note="Description of Artificial Sequence: Synthetic polynucleotide"
caggtgcagttgcaggagtcgggcccaggactggtgaagccttcagagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1807 - DNA, 378 bp, Artificial Sequence; identical to SEQ ID NO: 1806
  source: /note="Description of Artificial Sequence: Synthetic polynucleotide"

SEQ ID NO: 1808 - DNA, 378 bp, Artificial Sequence
  source: /note="Description of Artificial Sequence: Synthetic polynucleotide"
caggtgcagttgcaggagtcgggcccaggactggtgaagccttcacagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1809 - DNA, 378 bp, Artificial Sequence
  source: /note="Description of Artificial Sequence: Synthetic polynucleotide"
caggtgcagttgcaggagtcgggcccaggactggtgaagccttcagagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctca

SEQ ID NO: 1810 - DNA, 378 bp, Artificial Sequence; identical to SEQ ID NO: 1736
  source: /note="Description of Artificial Sequence: Synthetic polynucleotide"

SEQ ID NO: 1811 - DNA, 378 bp, Artificial Sequence; identical to SEQ ID NO: 1809
  source: /note="Description of Artificial Sequence: Synthetic polynucleotide"

SEQ ID NO: 1812 - DNA, 378 bp, Artificial Sequence; identical to SEQ ID NO: 1808
  source: /note="Description of Artificial Sequence: Synthetic polynucleotide"

SEQ ID NO: 1813 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1814 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1815 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1816 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1817 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1818 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1819 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1820 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1821 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctca

SEQ ID NO: 1822 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctca

SEQ ID NO: 1823 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctca

SEQ ID NO: 1824 - DNA, 369 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1825 - DNA, 369 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1826 - DNA, 369 bp, Artificial Sequence; identical to SEQ ID NO: 1824
  source: /note="Description of Artificial Sequence: Synthetic polynucleotide"

SEQ ID NO: 1827 - DNA, 369 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctca

SEQ ID NO: 1828 - DNA, 369 bp, Artificial Sequence; identical to SEQ ID NO: 1734
  source: /note="Description of Artificial Sequence: Synthetic polynucleotide"

SEQ ID NO: 1829 - DNA, 369 bp, Artificial Sequence; identical to SEQ ID NO: 1827
  source: /note="Description of Artificial Sequence: Synthetic polynucleotide"

SEQ ID NO: 1830 - DNA, 369 bp, Artificial Sequence; identical to SEQ ID NO: 1825
  source: /note="Description of Artificial Sequence: Synthetic polynucleotide"

SEQ ID NO: 1831 - DNA, 369 bp, Artificial Sequence
  source: /note="Description of Artificial Sequence: Synthetic polynucleotide"
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagcctgagatctgacgacacggccgtgtatttctgtgcgagagaggccacgatttttggaatgcttattgtaccatttgactactggggccagggaaccctggtcaccgtctcctca

SEQ ID NO: 1832 - DNA, 369 bp, Artificial Sequence
  source: /note="Description of Artificial Sequence: Synthetic polynucleotide"
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctca

SEQ ID NO: 1833 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1834 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1835 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctca

SEQ ID NO: 1836 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcagcctgagatctgacgacacggccgtgtattactgtgcgagagaggccacgatttttggaatggttattgtaccgtttgactactggggccagggaaccctggtcaccgtctcctca

SEQ ID NO: 1837 - DNA, 369 bp, Artificial Sequence; identical to SEQ ID NO: 1833
  source: /note="Description of Artificial Sequence: Synthetic polynucleotide"

SEQ ID NO: 1838 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1839 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1840 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1841 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1842 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctca

SEQ ID NO: 1843 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1844 - DNA, 369 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctca

SEQ ID NO: 1845 - DNA, 369 bp, Artificial Sequence; identical to SEQ ID NO: 1838
  source: /note="Description of Artificial Sequence: Synthetic polynucleotide"

SEQ ID NO: 1846 - DNA, 369 bp, Artificial Sequence; identical to SEQ ID NO: 1842
  source: /note="Description of Artificial Sequence: Synthetic polynucleotide"

SEQ ID NO: 1847 - DNA, 369 bp, Artificial Sequence; identical to SEQ ID NO: 1839
  source: /note="Description of Artificial Sequence: Synthetic polynucleotide"

SEQ ID NO: 1848 - DNA, 369 bp, Artificial Sequence; identical to SEQ ID NO: 1841
  source: /note="Description of Artificial Sequence: Synthetic polynucleotide"

SEQ ID NO: 1849 - DNA, 369 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcagcctgagatctgacgacacggccgtgtattactgtgcgagagaggccacgatttttggaatgcttattgtaccatttgactactggggccagggaaccctggtcaccgtctcctca

SEQ ID NO: 1850 - DNA, 369 bp, Artificial Sequence; identical to SEQ ID NO: 1849
  source: /note="Description of Artificial Sequence: Synthetic polynucleotide"

SEQ ID NO: 1851 - DNA, 384 bp, Artificial Sequence; identical to SEQ ID NO: 1728
  source: /note="Description of Artificial Sequence: Synthetic polynucleotide"

SEQ ID NO: 1852 - DNA, 384 bp, Artificial Sequence; identical to SEQ ID NO: 1728
  source: /note="Description of Artificial Sequence: Synthetic polynucleotide"

SEQ ID NO: 1853 - DNA, 384 bp, Artificial Sequence; identical to SEQ ID NO: 1728
  source: /note="Description of Artificial Sequence: Synthetic polynucleotide"

SEQ ID NO: 1854 - DNA, 384 bp, Artificial Sequence; identical to SEQ ID NO: 1728
  source: /note="Description of Artificial Sequence: Synthetic polynucleotide"

SEQ ID NO: 1855 - DNA, 384 bp, Artificial Sequence; identical to SEQ ID NO: 1728
  source: /note="Description of Artificial Sequence: Synthetic polynucleotide"

SEQ ID NO: 1856 - DNA, 384 bp, Artificial Sequence; identical to SEQ ID NO: 1728
  source: /note="Description of Artificial Sequence: Synthetic polynucleotide"

SEQ ID NO: 1857 - DNA, 384 bp, Artificial Sequence; identical to SEQ ID NO: 1728
  source: /note="Description of Artificial Sequence: Synthetic polynucleotide"

SEQ ID NO: 1858 - DNA, 384 bp, Artificial Sequence; identical to SEQ ID NO: 1728
  source: /note="Description of Artificial Sequence: Synthetic polynucleotide"

SEQ ID NO: 1859 - DNA, 384 bp, Artificial Sequence; identical to SEQ ID NO: 1728
  source: /note="Description of Artificial Sequence: Synthetic polynucleotide"

SEQ ID NO: 1860 - DNA, 384 bp, Artificial Sequence; identical to SEQ ID NO: 1728
  source: /note="Description of Artificial Sequence: Synthetic polynucleotide"

SEQ ID NO: 1861 - DNA, 384 bp, Artificial Sequence; identical to SEQ ID NO: 1728
  source: /note="Description of Artificial Sequence: Synthetic polynucleotide"

SEQ ID NO: 1862 - DNA, 384 bp, Artificial Sequence; identical to SEQ ID NO: 1728
  source: /note="Description of Artificial Sequence: Synthetic polynucleotide"

SEQ ID NO: 1863 - DNA, 384 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcagcctgaggtctgacgacacggccgtgtattactgtgcgagagggggggattacgttttcgggacttatcggcctcactactactacggtatggacgtctggggccaagggaccacggtcaccgtctcctca

SEQ ID NO: 1864 - DNA, 384 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgttttcgggacttatcggcctcactactactacggtatggacgtctggggccaagggaccacggtcaccgtctcctca

SEQ ID NO: 1865 - DNA, 363 bp, Artificial Sequence; identical to SEQ ID NO: 1765
  source: /note="Description of Artificial Sequence: Synthetic polynucleotide"

SEQ ID NO: 1866 - DNA, 363 bp, Artificial Sequence; identical to SEQ ID NO: 1747
  source: /note="Description of Artificial Sequence: Synthetic polynucleotide"

SEQ ID NO: 1867 - DNA, 384 bp, Artificial Sequence; identical to SEQ ID NO: 1728
  source: /note="Description of Artificial Sequence: Synthetic polynucleotide"

SEQ ID NO: 1868 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatggaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1869 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctca

SEQ ID NO: 1870 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1871 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1872 - DNA, 363 bp, Artificial Sequence; identical to SEQ ID NO: 1870
  source: /note="Description of Artificial Sequence: Synthetic polynucleotide"

SEQ ID NO: 1873 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacattggtcaccgtctcttca

SEQ ID NO: 1874 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1875 - DNA, 363 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttca

SEQ ID NO: 1876 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctca

SEQ ID NO: 1877 - DNA, 387 bp, Artificial Sequence; identical to SEQ ID NO: 1869
  source: /note="Description of Artificial Sequence: Synthetic polynucleotide"

SEQ ID NO: 1878 - DNA, 387 bp, Artificial Sequence; identical to SEQ ID NO: 1876
  source: /note="Description of Artificial Sequence: Synthetic polynucleotide"

SEQ ID NO: 1879 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctca

SEQ ID NO: 1880 - DNA, 387 bp, Artificial Sequence; identical to SEQ ID NO: 1876
  source: /note="Description of Artificial Sequence: Synthetic polynucleotide"

SEQ ID NO: 1881 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtaacacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctca

SEQ ID NO: 1882 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgttttcgggagttatcgtccctactactactactacggtatggacgtctggggccaagggaccacggtcaccgtctcctca

SEQ ID NO: 1883 - DNA, 387 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgttttcgggagttatcgtccctactactactactacggtatggacgtctggggccaagggaccacggtcaccgtctcctca

SEQ ID NO: 1884 - DNA, 363 bp, Artificial Sequence; identical to SEQ ID NO: 1873
  source: /note="Description of Artificial Sequence: Synthetic polynucleotide"

SEQ ID NO: 1885 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1886 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1887 - DNA, 642 bp, Artificial Sequence; identical to SEQ ID NO: 1886
  source: /note="Description of Artificial Sequence: Synthetic polynucleotide"

SEQ ID NO: 1888 - DNA, 639 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagatattgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1889 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagcaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1890 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagaaaccaggacatcctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1891 - DNA, 660 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1892 - DNA, 660 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1893 - DNA, 645 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagacaggagcctgatgattttgcagtgtattactgtcagcagtatggtagttcaccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1894 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccagggtcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1895 - DNA, 642 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1896 - DNA, 639 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagatattgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1897 - DNA, 642 bp, Artificial Sequence
  source: /note="Description of Artificial Sequence: Synthetic polynucleotide"
gacatccagatgacccagtctccatcttccgtgtctgcatctgtaggagacagagtcaccatcacttgtcgggcgagtcagggtcttatcatctggttagcctggtatcagcagaaaccggggaaagcccctaaactcctgatctatgctgcatccagtttgcaaagtggggtcccatcaaggttcagcggcagtggctctgggacagatttcactctcaccatcagcagcctacagcctgaagattttgcaacttactattgtcaacagactaacagtttccctccgacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1898 - DNA, 642 bp, Artificial Sequence; identical to SEQ ID NO: 1897
  source: /note="Description of Artificial Sequence: Synthetic polynucleotide"

SEQ ID NO: 1899 - DNA, 642 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1900 - DNA, 642 bp, Artificial Sequence; identical to SEQ ID NO: 1899
  source: /note="Description of Artificial Sequence: Synthetic polynucleotide"

SEQ ID NO: 1901 - DNA, 642 bp, Artificial Sequence; identical to SEQ ID NO: 1899
  source: /note="Description of Artificial Sequence: Synthetic polynucleotide"

SEQ ID NO: 1902 - DNA, 642 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaactcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccctgggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1903 - DNA, 642 bp, Artificial Sequence
  source: /note="Description of Artificial Sequence: Synthetic polynucleotide"
gacattcagatgacccagtctccatcctccctgtctgcatctgtaggagacagagtcaccatcacttgccgggcaagtcagggcattagaaatgagttaggctggtatcagcagaaaccagggaaagcccctaaacgcctgatctatggtgcatccagtttgcaaagtggggtcccatcaaggttcagcggcagtggatctgggacagagttcactctcacaatcagcagcctgcagcctgaagattttgtaacttattactgtctacagcataatagttacccattcactttcggccaagggaccaaagtggatgtcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1904 - DNA, 642 bp, Artificial Sequence; identical to SEQ ID NO: 1899
  source: /note="Description of Artificial Sequence: Synthetic polynucleotide"

SEQ ID NO: 1905 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1906 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1907 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggacattagagattatttaggctggtatcagcagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1908 - DNA, 642 bp, Artificial Sequence; identical to SEQ ID NO: 1905
  source: /note="Description of Artificial Sequence: Synthetic polynucleotide"

SEQ ID NO: 1909 - DNA, 642 bp, Artificial Sequence; identical to SEQ ID NO: 1905
  source: /note="Description of Artificial Sequence: Synthetic polynucleotide"

SEQ ID NO: 1910 - DNA, 642 bp, Artificial Sequence; identical to SEQ ID NO: 1905
  source: /note="Description of Artificial Sequence: Synthetic polynucleotide"

SEQ ID NO: 1911 - DNA, 642 bp, Artificial Sequence; identical to SEQ ID NO: 1905
  source: /note="Description of Artificial Sequence: Synthetic polynucleotide"

SEQ ID NO: 1912 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaccagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1913 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1914 - DNA, 642 bp, Artificial Sequence; identical to SEQ ID NO: 1913
  source: /note="Description of Artificial Sequence: Synthetic polynucleotide"

SEQ ID NO: 1915 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaccagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1916 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1917 - DNA, 642 bp, Artificial Sequence; identical to SEQ ID NO: 1916
  source: /note="Description of Artificial Sequence: Synthetic polynucleotide"

SEQ ID NO: 1918 - DNA, 642 bp, Artificial Sequence; identical to SEQ ID NO: 1915
  source: /note="Description of Artificial Sequence: Synthetic polynucleotide"

SEQ ID NO: 1919 - DNA, 642 bp, Artificial Sequence; identical to SEQ ID NO: 1912
  source: /note="Description of Artificial Sequence: Synthetic polynucleotide"

SEQ ID NO: 1920 - DNA, 642 bp, Artificial Sequence; identical to SEQ ID NO: 1913
  source: /note="Description of Artificial Sequence: Synthetic polynucleotide"

SEQ ID NO: 1921 - DNA, 642 bp, Artificial Sequence; identical to SEQ ID NO: 1913
  source: /note="Description of Artificial Sequence: Synthetic polynucleotide"

SEQ ID NO: 1922 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagctcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1923 - DNA, 642 bp, Artificial Sequence; identical to SEQ ID NO: 1913
  source: /note="Description of Artificial Sequence: Synthetic polynucleotide"

SEQ ID NO: 1924 - DNA, 639 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagattttgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1925 - DNA, 639 bp, Artificial Sequence; identical to SEQ ID NO: 1924
  source: /note="Description of Artificial Sequence: Synthetic polynucleotide"

SEQ ID NO: 1926 - DNA, 639 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtctcaccatcagcagcctgcagcctgaagatattgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1927 - DNA, 639 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttagtttcaccatcagcagcctgcagcctgaagattttgcaacatattactgtcaacagtatgatattctcctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1928 - DNA, 639 bp, Artificial Sequence; identical to SEQ ID NO: 1926
  source: /note="Description of Artificial Sequence: Synthetic polynucleotide"

SEQ ID NO: 1929 - DNA, 639 bp, Artificial Sequence; identical to SEQ ID NO: 1927
  source: /note="Description of Artificial Sequence: Synthetic polynucleotide"

SEQ ID NO: 1930 - DNA, 639 bp, Artificial Sequence; identical to SEQ ID NO: 1888
  source: /note="Description of Artificial Sequence: Synthetic polynucleotide"

SEQ ID NO: 1931 - DNA, 639 bp, Artificial Sequence; identical to SEQ ID NO: 1924
  source: /note="Description of Artificial Sequence: Synthetic polynucleotide"

SEQ ID NO: 1932 - DNA, 639 bp, Artificial Sequence; identical to SEQ ID NO: 1924
  source: /note="Description of Artificial Sequence: Synthetic polynucleotide"

SEQ ID NO: 1933 - DNA, 642 bp, Artificial Sequence; identical to SEQ ID NO: 1886
  source: /note="Description of Artificial Sequence: Synthetic polynucleotide"

SEQ ID NO: 1934 - DNA, 642 bp, Artificial Sequence; identical to SEQ ID NO: 1886
  source: /note="Description of Artificial Sequence: Synthetic polynucleotide"

SEQ ID NO: 1935 - DNA, 642 bp, Artificial Sequence; identical to SEQ ID NO: 1905
  source: /note="Description of Artificial Sequence: Synthetic polynucleotide"

SEQ ID NO: 1936 - DNA, 642 bp, Artificial Sequence; identical to SEQ ID NO: 1905
  source: /note="Description of Artificial Sequence: Synthetic polynucleotide"

SEQ ID NO: 1937 - DNA, 642 bp, Artificial Sequence; identical to SEQ ID NO: 1907
  source: /note="Description of Artificial Sequence: Synthetic polynucleotide"

SEQ ID NO: 1938 - DNA, 642 bp, Artificial Sequence; identical to SEQ ID NO: 1907
  source: /note="Description of Artificial Sequence: Synthetic polynucleotide"

SEQ ID NO: 1939 - DNA, 642 bp, Artificial Sequence; identical to SEQ ID NO: 1907
  source: /note="Description of Artificial Sequence: Synthetic polynucleotide"

SEQ ID NO: 1940 - DNA, 639 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1941 - DNA, 639 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagatattgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1942 - DNA, 639 bp, Artificial Sequence; identical to SEQ ID NO: 1940
  source: /note="Description of Artificial Sequence: Synthetic polynucleotide"

SEQ ID NO: 1943 - DNA, 639 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactttcaccatcagcagcctgcagcctgaagattttgcaacatattactgtcaacagtatgatgatctattcactttcggccctgggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1944 - DNA, 639 bp, Artificial Sequence; identical to SEQ ID NO: 1941
  source: /note="Description of Artificial Sequence: Synthetic polynucleotide"

SEQ ID NO: 1945 - DNA, 639 bp, Artificial Sequence; identical to SEQ ID NO: 1943
  source: /note="Description of Artificial Sequence: Synthetic polynucleotide"

SEQ ID NO: 1946 - DNA, 639 bp, Artificial Sequence; identical to SEQ ID NO: 1896
  source: /note="Description of Artificial Sequence: Synthetic polynucleotide"

SEQ ID NO: 1947 - DNA, 639 bp, Artificial Sequence; identical to SEQ ID NO: 1940
  source: /note="Description of Artificial Sequence: Synthetic polynucleotide"

SEQ ID NO: 1948 - DNA, 639 bp, Artificial Sequence; identical to SEQ ID NO: 1940
  source: /note="Description of Artificial Sequence: Synthetic polynucleotide"

SEQ ID NO: 1949 - DNA, 639 bp, Artificial Sequence
  source: /note="Description of Artificial Sequence: Synthetic polynucleotide"
gacatccagatgacccagtctccatcctccctgtctgcatctgtgggggacagagtcaccatcacttgccaggcgagtcaggacattaccaactatttaaattggtatcagcagaaaccagggaaagcccctaaactcctgatctacgatgcttccaatttggagccaggggtcccatcaaggttcagtggaagtggatctgggacagattttactctcaccatcagcagcctgcagcctgaagattttgcaacatattactgtcaacagtatgatgatctattcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1950 - DNA, 639 bp, Artificial Sequence; identical to SEQ ID NO: 1949
  source: /note="Description of Artificial Sequence: Synthetic polynucleotide"

SEQ ID NO: 1951 - DNA, 642 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagatttttaccagcacctacttagcctggtaccagcagaaacctggccaggctcccaggctcctcatctatggtgcatccagcagggccactggcatcccagacaggttcagtggcagtgggtctgggacagacttcactctcaccatcagcagattggagcctgaagattttgcagtgtattactgtcagcagtatggtagctcacctcgcttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1952 - DNA, 642 bp, Artificial Sequence; identical to SEQ ID NO: 1951
  source: /note="Description of Artificial Sequence: Synthetic polynucleotide"

SEQ ID NO: 1953 - DNA, 642 bp, Artificial Sequence; identical to SEQ ID NO: 1951
  source: /note="Description of Artificial Sequence: Synthetic polynucleotide"

SEQ ID NO: 1954 - DNA, 642 bp, Artificial Sequence; identical to SEQ ID NO: 1951
  source: /note="Description of Artificial Sequence: Synthetic polynucleotide"

SEQ ID NO: 1955 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1956 - DNA, 642 bp, Artificial Sequence; identical to SEQ ID NO: 1955
  source: /note="Description of Artificial Sequence: Synthetic polynucleotide"

SEQ ID NO: 1957 - DNA, 642 bp, Artificial Sequence; identical to SEQ ID NO: 1955
  source: /note="Description of Artificial Sequence: Synthetic polynucleotide"

SEQ ID NO: 1958 - DNA, 642 bp, Artificial Sequence; identical to SEQ ID NO: 1894
  source: /note="Description of Artificial Sequence: Synthetic polynucleotide"

SEQ ID NO: 1959 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataacttccctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1960 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactatcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1961 - DNA, 642 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcagccaccagggccactggtatcccagccaggttcagtggcagtgggtctgggacagagttcactctcaccatcagcagcctggagcctgaagattttgcagtttattactgtcagcagtataataactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1962 - DNA, 642 bp, Artificial Sequence; identical to SEQ ID NO: 1961
  source: /note="Description of Artificial Sequence: Synthetic polynucleotide"

SEQ ID NO: 1963 - DNA, 645 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtattagttacagttacttagcctggtaccagcagaaacctggccaggctccccggctcctcatctatggtgcatccagcagggccactggcatcccagacaggttcagtggcagtgggtctgggacagacttcactctcaccatcagcagactggagcctgatgattttgcagtgtattactgtcagcagtatggtagttcaccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1964 - DNA, 645 bp, Artificial Sequence; identical to SEQ ID NO: 1893
  source: /note="Description of Artificial Sequence: Synthetic polynucleotide"

SEQ ID NO: 1965 - DNA, 645 bp, Artificial Sequence; identical to SEQ ID NO: 1963
  source: /note="Description of Artificial Sequence: Synthetic polynucleotide"

SEQ ID NO: 1966 - DNA, 645 bp, Artificial Sequence; identical to SEQ ID NO: 1963
  source: /note="Description of Artificial Sequence: Synthetic polynucleotide"

SEQ ID NO: 1967 - DNA, 645 bp, Artificial Sequence; identical to SEQ ID NO: 1963
  source: /note="Description of Artificial Sequence: Synthetic polynucleotide"

SEQ ID NO: 1968 - DNA, 645 bp, Artificial Sequence; identical to SEQ ID NO: 1893
  source: /note="Description of Artificial Sequence: Synthetic polynucleotide"

SEQ ID NO: 1969 - DNA, 645 bp, Artificial Sequence; identical to SEQ ID NO: 1893
  source: /note="Description of Artificial Sequence: Synthetic polynucleotide"

SEQ ID NO: 1970 - DNA, 660 bp, Artificial Sequence; identical to SEQ ID NO: 1889
  source: /note="Description of Artificial Sequence: Synthetic polynucleotide"

SEQ ID NO: 1971 - DNA, 660 bp, Artificial Sequence; identical to SEQ ID NO: 1889
  source: /note="Description of Artificial Sequence: Synthetic polynucleotide"

SEQ ID NO: 1972 - DNA, 660 bp, Artificial Sequence; identical to SEQ ID NO: 1889
  source: /note="Description of Artificial Sequence: Synthetic polynucleotide"

SEQ ID NO: 1973 - DNA, 660 bp, Artificial Sequence; identical to SEQ ID NO: 1889
  source: /note="Description of Artificial Sequence: Synthetic polynucleotide"

SEQ ID NO: 1974 - DNA, 660 bp, Artificial Sequence; identical to SEQ ID NO: 1889
  source: /note="Description of Artificial Sequence: Synthetic polynucleotide"

SEQ ID NO: 1975 - DNA, 660 bp, Artificial Sequence; identical to SEQ ID NO: 1889
  source: /note="Description of Artificial Sequence: Synthetic polynucleotide"

SEQ ID NO: 1976 - DNA, 660 bp, Artificial Sequence; identical to SEQ ID NO: 1889
  source: /note="Description of Artificial Sequence: Synthetic polynucleotide"

SEQ ID NO: 1977 - DNA, 660 bp, Artificial Sequence; identical to SEQ ID NO: 1889
  source: /note="Description of Artificial Sequence: Synthetic polynucleotide"

SEQ ID NO: 1978 - DNA, 660 bp, Artificial Sequence; identical to SEQ ID NO: 1889
  source: /note="Description of Artificial Sequence: Synthetic polynucleotide"

SEQ ID NO: 1979 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacatagcttggtaccagcagaaaccaggacaacctcctaagctgctcatttactgggcatctacccgggaatccggggtccctgaccgattcagtggcagcgggtctgggacagatttcactctcaccatcagcagcctgcaggctgaagatgtggcagttttttactgtcaacaatattatagtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1980 - DNA, 660 bp, Artificial Sequence; identical to SEQ ID NO: 1979
  source: /note="Description of Artificial Sequence: Synthetic polynucleotide"

SEQ ID NO: 1981 - DNA, 660 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccaacagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1982 - DNA, 660 bp, Artificial Sequence; identical to SEQ ID NO: 1981
  source: /note="Description of Artificial Sequence: Synthetic polynucleotide"

SEQ ID NO: 1983 - DNA, 660 bp, Artificial Sequence; identical to SEQ ID NO: 1891
  source: /note="Description of Artificial Sequence: Synthetic polynucleotide"

SEQ ID NO: 1984 - DNA, 660 bp, Artificial Sequence; identical to SEQ ID NO: 1981
  source: /note="Description of Artificial Sequence: Synthetic polynucleotide"

SEQ ID NO: 1985 - DNA, 660 bp, Artificial Sequence; identical to SEQ ID NO: 1981
  source: /note="Description of Artificial Sequence: Synthetic polynucleotide"

SEQ ID NO: 1986 - DNA, 660 bp, Artificial Sequence; identical to SEQ ID NO: 1891
  source: /note="Description of Artificial Sequence: Synthetic polynucleotide"

SEQ ID NO: 1987 - DNA, 660 bp, Artificial Sequence; identical to SEQ ID NO: 1891
  source: /note="Description of Artificial Sequence: Synthetic polynucleotide"

SEQ ID NO: 1988 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccaacagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1989 - DNA, 660 bp, Artificial Sequence; identical to SEQ ID NO: 1981
  source: /note="Description of Artificial Sequence: Synthetic polynucleotide"

SEQ ID NO: 1990 - DNA, 660 bp, Artificial Sequence; identical to SEQ ID NO: 1890
  source: /note="Description of Artificial Sequence: Synthetic polynucleotide"

SEQ ID NO: 1991 - DNA, 660 bp, Artificial Sequence; identical to SEQ ID NO: 1890
  source: /note="Description of Artificial Sequence: Synthetic polynucleotide"

SEQ ID NO: 1992 - DNA, 660 bp, Artificial Sequence; identical to SEQ ID NO: 1890
  source: /note="Description of Artificial Sequence: Synthetic polynucleotide"

SEQ ID NO: 1993 - DNA, 660 bp, Artificial Sequence; identical to SEQ ID NO: 1979
  source: /note="Description of Artificial Sequence: Synthetic polynucleotide"

SEQ ID NO: 1994 - DNA, 660 bp, Artificial Sequence; identical to SEQ ID NO: 1979
  source: /note="Description of Artificial Sequence: Synthetic polynucleotide"

SEQ ID NO: 1995 - DNA, 660 bp, Artificial Sequence; identical to SEQ ID NO: 1892
  source: /note="Description of Artificial Sequence: Synthetic polynucleotide"

SEQ ID NO: 1996 - DNA, 660 bp, Artificial Sequence; identical to SEQ ID NO: 1892
  source: /note="Description of Artificial Sequence: Synthetic polynucleotide"

SEQ ID NO: 1997 - DNA, 660 bp, Artificial Sequence; identical to SEQ ID NO: 1892
  source: /note="Description of Artificial Sequence: Synthetic polynucleotide"

SEQ ID NO: 1998 - DNA, 660 bp, Artificial Sequence; identical to SEQ ID NO: 1892
  source: /note="Description of Artificial Sequence: Synthetic polynucleotide"

SEQ ID NO: 1999 - DNA, 660 bp, Artificial Sequence; identical to SEQ ID NO: 1892
  source: /note="Description of Artificial Sequence: Synthetic polynucleotide"

SEQ ID NO: 2000 - DNA, 660 bp, Artificial Sequence; identical to SEQ ID NO: 1892
  source: /note="Description of Artificial Sequence: Synthetic polynucleotide"

SEQ ID NO: 2001 - DNA, 660 bp, Artificial Sequence; identical to SEQ ID NO: 1892
  source: /note="Description of Artificial Sequence: Synthetic polynucleotide"

SEQ ID NO: 2002 - DNA, 660 bp, Artificial Sequence
  source: /note="Description of Artificial Sequence: Synthetic polynucleotide"
gacatcgtgatgacccagtctccagactccctgtctgtgtctctgggcgagagggccaccatcaactgcaagtccagccagagtgttttatccagctccaacaataagaactacttagcttggtaccagcagaaaccaggacagcctcctaacctgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2003 - DNA, 660 bp, Artificial Sequence; identical to SEQ ID NO: 2002
  source: /note="Description of Artificial Sequence: Synthetic polynucleotide"

SEQ ID NO: 2004 - DNA, 660 bp, Artificial Sequence; identical to SEQ ID NO: 2002
  source: /note="Description of Artificial Sequence: Synthetic polynucleotide"

SEQ ID NO: 2005 - DNA, 660 bp, Artificial Sequence; identical to SEQ ID NO: 2002
  source: /note="Description of Artificial Sequence: Synthetic polynucleotide"

SEQ ID NO: 2006 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagattccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2007 - DNA, 660 bp, Artificial Sequence
  source: /note="Description of Artificial Sequence: Synthetic polynucleotide"
gacatcgtgatgacccagtctccagactccctggctgtgtctctgggcgagagggccaccatcaactgcaagtccagccagagtgttttatccagctccaacaataagaactacttagcttggtaccagcagaaaccaggacagcctcctaaactgctcatttactggacttctacccgagaatccggggtccctgaccgattcagtggcagcgggtctgggacagatttcactctcaccatcaacagcctgcaggctgaagatgtggctgtttattactgtcagcaatattatcgtactccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2008 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2009 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2010 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2011 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2012 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtcaaactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2013 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2014 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgaaagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2015 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgcaaggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2016 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2017 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatgacagcctgaatgctccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2018 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2019 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaattatgtaaactggtaccagcacctcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgaatgctccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2020 - DNA, 648 bp, Artificial Sequence; identical to SEQ ID NO: 2019
  source: /note="Description of Artificial Sequence: Synthetic polynucleotide"

SEQ ID NO: 2021 - DNA, 648 bp, Artificial Sequence; identical to SEQ ID NO: 2008
  source: /note="Description of Artificial Sequence: Synthetic polynucleotide"

SEQ ID NO: 2022 - DNA, 642 bp, Artificial Sequence
  source: /note="Description of Artificial Sequence: Synthetic polynucleotide"
gacatccagatgacccagtctccatcctccctgtctgcatctataggagacagagtcaccatcacttgccgggcaagtcaggaccttagaaattatttaggctggtatcaacagaaaccagggaaagcccctaagcgcctgatctatggtgcatccagtttgcaaagtggggtcccttcaaggttcagcggcagtggatctgggacagaattcactctcacaatcagcagcctgcagcctgaagatttcgcaacttattactgtctacagcataataattaccccttcactttcggccaagggaccaaagtggatatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2023 - DNA, 642 bp, Artificial Sequence; identical to SEQ ID NO: 1906
  source: /note="Description of Artificial Sequence: Synthetic polynucleotide"

SEQ ID NO: 2024 - DNA, 648 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagtagctccaacatcggaagtaatactgtaaactggtaccagcaactcccaggaacggcccccaaactcctcatctatactaataatcagcggccctcaggggtccctgaccgattctctggctccaagtctggcacctcagcctcccttgccatcagtgggctccagtctgaggatgaggctgattatttctgtgcaacattcgatagcagcctgagtggtccggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2025 - DNA, 642 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcacacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2026 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatgagcagttcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2027 - DNA, 642 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctgagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2028 - DNA, 642 bp, Artificial Sequence; identical to SEQ ID NO: 2027
  source: /note="Description of Artificial Sequence: Synthetic polynucleotide"

SEQ ID NO: 2029 - DNA, 642 bp, Artificial Sequence; identical to SEQ ID NO: 2025
  source: /note="Description of Artificial Sequence: Synthetic polynucleotide"

SEQ ID NO: 2030 - DNA, 642 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgatcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2031 - DNA, 642 bp, Artificial Sequence; identical to SEQ ID NO: 2027
  source: /note="Description of Artificial Sequence: Synthetic polynucleotide"

SEQ ID NO: 2032 - DNA, 642 bp, Artificial Sequence; identical to SEQ ID NO: 2027
  source: /note="Description of Artificial Sequence: Synthetic polynucleotide"

SEQ ID NO: 2033 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2034 - DNA, 648 bp, Artificial Sequence; identical to SEQ ID NO: 2033
  source: /note="Description of Artificial Sequence: Synthetic polynucleotide"

SEQ ID NO: 2035 - DNA, 648 bp, Artificial Sequence; identical to SEQ ID NO: 2026
  source: /note="Description of Artificial Sequence: Synthetic polynucleotide"

SEQ ID NO: 2036 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacattcgaaagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2037 - DNA, 648 bp, Artificial Sequence
  source: /note="Description of Artificial Sequence: Synthetic polynucleotide"
cagtctgtgttgacgcagccgccctcagtgtctgcggccccaggacagaaggtcaccatctcctgctctggaagcagctccaacattggaaataattatgtatcctggtatcagcagctcccaggaacagcccccaaactcctcatttatgacaataataagcgaccctcagggattcctgaccgattctctggctccaagtctggcacgtcagccaccctggccatcaccggactccagactggggacgaggccgattattactgcggaacatgggatagcagcctgagtgctgtggtattcggcggagggaccaaactgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 2038 - DNA, 648 bp, Artificial Sequence; identical to SEQ ID NO: 2037
  source: /note="Description of Artificial Sequence: Synthetic polynucleotide"

SEQ ID NO: 2039 - DNA, 648 bp, Artificial Sequence; identical to SEQ ID NO: 2033
  source: /note="Description of Artificial Sequence: Synthetic polynucleotide"

SEQ ID NO: 2040 - DNA, 648 bp, Artificial Sequence; identical to SEQ ID NO: 2036
  source: /note="Description of Artificial Sequence: Synthetic polynucleotide"

SEQ ID NO: 2041 - DNA, 642 bp, Artificial Sequence
  source: /note="Description of Artificial Sequence: Synthetic polynucleotide"
gacatccagctgacccagtctccatcctccctgtctgcatctgtaggagacagagtcactatcacttgccgggcaagtcagaccattagcaggtttttaaattggtatcagcagaaacctgggaaagcccctaagctcctgatctatgttgcatccagtttgcaaagtggggtcccatcaagattcagtggcagtggttctgggacagatttcactctcaccatcagcagtctgcaacctgaagattttgcaacttactactgtcaacagagttacagtaccctgctcagttttggccaggggaccaagctggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 2042 - DNA, 1374 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgtttgggggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2043 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2044 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2045 - DNA, 1350 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2046 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2047 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2048 - DNA, 1359 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2049 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2050 - DNA, 1368 bp, Artificial Sequence
  source: /note="Description of Artificial Sequence: Synthetic polynucleotide"
caggtgcagttgcaggagtcgggcccaggactggtgaagccttcacagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2051 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2052 - DNA, 1353 bp, Artificial Sequence; identical to SEQ ID NO: 2044
  source: /note="Description of Artificial Sequence: Synthetic polynucleotide"

SEQ ID NO: 2053 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2054 - DNA, 1341 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctcagggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2055 - DNA, 1341 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctgggggctccatcagtagttactactggagctggatccggcagcccgccgggaagggactagagtggattggccgtatctataccagtgggagcaccaactacaacccctccctcaagagtcgagtcaccatgtcaatagacacgtccaagaaccagttctccctgaaactgaactctgtgaccgccgcggacacggccgtgtattactgtgcgagagatgtagcagtggctggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2056 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2057 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagactccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2058 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatggaagtaataaatactatgcagacgccgtgaagggccgcttcaccatctccagagacaattccaagaacacgctgtatctgcaaatgaacagcctgagagccgaggacacggctgtgtattactgtgcgcgagatgggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2059 - DNA, 1353 bp, Artificial Sequence; identical to SEQ ID NO: 2056
  source: /note="Description of Artificial Sequence: Synthetic polynucleotide"

SEQ ID NO: 2060 - DNA, 1353 bp, Artificial Sequence; identical to SEQ ID NO: 2056
  source: /note="Description of Artificial Sequence: Synthetic polynucleotide"

SEQ ID NO: 2061 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagttactttggcatgcactgggtccgccaggctccaggcaaggggctggagtgggtggcagttatatggtatgatgcaagtaataaatactatgcagacgccgtgaagggccgcttcaccatctccagagacaattccaagaacacgctgtatctgcaaatgaacagcctgagagccgaggacacggctgtgtattactgtgcgcgagataggacgatttttggagtgctcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2062 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2063 - DNA, 1353 bp, Artificial Sequence; identical to SEQ ID NO: 2062
  source: /note="Description of Artificial Sequence: Synthetic polynucleotide"

SEQ ID NO: 2064 - DNA, 1353 bp, Artificial Sequence; identical to SEQ ID NO: 2062
  source: /note="Description of Artificial Sequence: Synthetic polynucleotide"

SEQ ID NO: 2065 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagactccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2066 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatggaagtaatgaaaactatgcagacgccgtgaagggccgattcaccatctccagagacaattccaagaatacgctgtatctgcacatgaacagcctgagagtcgcggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2067 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagataggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2068 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggctccaggcaaggggctggagtgggtggcagttatatggtatgatgcaagtaatgaaaactatgcagacgccgtgaagggccgattcaccatctccagagacaattccaagaatacgctgtatctgcaaatgaacagcctgagagtcgaggacacggctgtgtattattgtgcgcgagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2069 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagactccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2070 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2071 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcacatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2072 - DNA, 1353 bp, Artificial Sequence; identical to SEQ ID NO: 2070
  source: /note="Description of Artificial Sequence: Synthetic polynucleotide"

SEQ ID NO: 2073 - DNA, 1353 bp, Artificial Sequence; identical to SEQ ID NO: 2070
  source: /note="Description of Artificial Sequence: Synthetic polynucleotide"

SEQ ID NO: 2074 - DNA, 1353 bp, Artificial Sequence; identical to SEQ ID NO: 2071
  source: /note="Description of Artificial Sequence: Synthetic polynucleotide"

SEQ ID NO: 2075 - DNA, 1353 bp, Artificial Sequence; identical to SEQ ID NO: 2071
  source: /note="Description of Artificial Sequence: Synthetic polynucleotide"

SEQ ID NO: 2076 - DNA, 1353 bp, Artificial Sequence; identical to SEQ ID NO: 2070
  source: /note="Description of Artificial Sequence: Synthetic polynucleotide"

SEQ ID NO: 2077 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatggaagtaatgaaaactatgcagacgccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2078 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagactccgtgaagggccgattcaccatctccagagacaattccaagaacacgctgtatctgcaaatgaacagcctgagagccgcggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2079 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagataggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2080 - DNA, 1353 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcactttcagtaactttggcatgcactgggtccgccaggccccaggcaaggggctggagtgggtggcagttatatggtatgatgcaagtaatgaaaactatgcagacgccgtgaagggccgattcaccatctccagagacaattccaagaacacgctgtatctgcaaatgaacagcctgagagccgaggacacggctgtgtattactgtgcgagagatgggacgatctttggagtggtcttgggggactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2081 - DNA, 1350 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2082 - DNA, 1350 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagacgccgtgaagggccgattcaccatctccagcgacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2083 - DNA, 1350 bp, Artificial Sequence; identical to SEQ ID NO: 2081
  source: /note="Description of Artificial Sequence: Synthetic polynucleotide"

SEQ ID NO: 2084 - DNA, 1350 bp, Artificial Sequence; identical to SEQ ID NO: 2081
  source: /note="Description of Artificial Sequence: Synthetic polynucleotide"

SEQ ID NO: 2085 - DNA, 1350 bp, Artificial Sequence; identical to SEQ ID NO: 2082
  source: /note="Description of Artificial Sequence: Synthetic polynucleotide"

SEQ ID NO: 2086 - DNA, 1350 bp, Artificial Sequence; identical to SEQ ID NO: 2082
  source: /note="Description of Artificial Sequence: Synthetic polynucleotide"

SEQ ID NO: 2087 - DNA, 1350 bp, Artificial Sequence; identical to SEQ ID NO: 2081
  source: /note="Description of Artificial Sequence: Synthetic polynucleotide"

SEQ ID NO: 2088 - DNA, 1350 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgcaagtaataaatactatgcagactccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2089 - DNA, 1350 bp, Artificial Sequence
  source: /note="Description of Artificial Sequence: Synthetic polynucleotide"
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagacgccgtgaagggccgattcaccatctccagggacaattccaagaacacgctgtatctgcaaatgaacagcctgagagccgaggacacggctgtgtattactgtgcgagagataggacgatttttggagtggttcttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2090 - DNA, 1353 bp, Artificial Sequence; identical to SEQ ID NO: 2056
  source: /note="Description of Artificial Sequence: Synthetic polynucleotide"

SEQ ID NO: 2091 - DNA, 1353 bp, Artificial Sequence; identical to SEQ ID NO: 2061
  source: /note="Description of Artificial Sequence: Synthetic polynucleotide"

SEQ ID NO: 2092 - DNA, 1353 bp, Artificial Sequence; identical to SEQ ID NO: 2056
  source: /note="Description of Artificial Sequence: Synthetic polynucleotide"

SEQ ID NO: 2093 - DNA, 1353 bp, Artificial Sequence; identical to SEQ ID NO: 2061
  source: /note="Description of Artificial Sequence: Synthetic polynucleotide"

SEQ ID NO: 2094 - DNA, 1353 bp, Artificial Sequence; identical to SEQ ID NO: 2044
  source: /note="Description of Artificial Sequence: Synthetic polynucleotide"

SEQ ID NO: 2095 - DNA, 1353 bp, Artificial Sequence; identical to SEQ ID NO: 2057
  source: /note="Description of Artificial Sequence: Synthetic polynucleotide"

SEQ ID NO: 2096 - DNA, 1353 bp, Artificial Sequence; identical to SEQ ID NO: 2058
  source: /note="Description of Artificial Sequence: Synthetic polynucleotide"

SEQ ID NO: 2097 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2098 - DNA, 1350 bp, Artificial Sequence; identical to SEQ ID NO: 2097
  source: /note="Description of Artificial Sequence: Synthetic polynucleotide"

SEQ ID NO: 2099 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtacctcggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2100 - DNA, 1350 bp, Artificial Sequence; identical to SEQ ID NO: 2097
  source: /note="Description of Artificial Sequence: Synthetic polynucleotide"

SEQ ID NO: 2101 - DNA, 1350 bp, Artificial Sequence; identical to SEQ ID NO: 2099
  source: /note="Description of Artificial Sequence: Synthetic polynucleotide"

SEQ ID NO: 2102 - DNA, 1350 bp, Artificial Sequence; identical to SEQ ID NO: 2099
  source: /note="Description of Artificial Sequence: Synthetic polynucleotide"

SEQ ID NO: 2103 - DNA, 1350 bp, Artificial Sequence; identical to SEQ ID NO: 2097
  source: /note="Description of Artificial Sequence: Synthetic polynucleotide"

SEQ ID NO: 2104 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatggaaataataaatactatgcagacgccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2105 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattctccttcagtagctatggcatgcactgggtccgccagcctccaggcaaggggctggagtgggtggcagctatatggtatgatgcaaataataaatactatgcagactccgtgaagggccgattcaccatctccagagacagttccaagaacacgctgtatctgcaaatgaacagcctgagagccgaggacacggctgtgtattactgtgcgagagatcggacgatttttggagtggtccttgagtactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2106 - DNA, 1350 bp, Artificial Sequence; identical to SEQ ID NO: 2097
  source: /note="Description of Artificial Sequence: Synthetic polynucleotide"

SEQ ID NO: 2107 - DNA, 1350 bp, Artificial Sequence; identical to SEQ ID NO: 2099
  source: /note="Description of Artificial Sequence: Synthetic polynucleotide"

SEQ ID NO: 2108 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2109 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2110 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatggaagtaataaatactatgaagacgccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2111 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcagtttcagtagctatggcatgcactgggtccgccaggctccaggcaagggactggagtgggtggcagttatatggtatgatgcaagtaataaatactatgaagactccgtgaagggccgattcaccatctccagagacaattccaagaacacgctgtttctgcaagtgaacagcctgagagccgaggacacggctgtgtattactgtgcgagagggattacgatttttggtcatgggtttgaatattggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2112 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2113 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatgcaagtgataaatactatgcagactccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2114 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcgaggggctggagtgggtggcagctatatggtttgatggaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2115 - DNA, 1350 bp, Artificial Sequence; identical to SEQ ID NO: 2112
  source: /note="Description of Artificial Sequence: Synthetic polynucleotide"

SEQ ID NO: 2116 - DNA, 1350 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcatctggattcaccttcagtaactatggcatgcactgggtccgccaggctccaggcaaggggctggagtgggtggcagctatatggtttgatgcaagtgataaatactatgcagacgccgtgaagggccgattcaccatctccagagacaactccaagaacacgctgtatctgcaaatgaacagcctgagagccgaggacacggctgtgtattactgtgcgagagatcaggcgatttttggagtggtccccgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2117 - DNA, 1350 bp, Artificial Sequence; identical to SEQ ID NO: 2116
  source: /note="Description of Artificial Sequence: Synthetic polynucleotide"

SEQ ID NO: 2118 - DNA, 1350 bp, Artificial Sequence; identical to SEQ ID NO: 2112
  source: /note="Description of Artificial Sequence: Synthetic polynucleotide"

SEQ ID NO: 2119 - DNA, 1350 bp, Artificial Sequence; identical to SEQ ID NO: 2116
  source: /note="Description of Artificial Sequence: Synthetic polynucleotide"

SEQ ID NO: 2120 - DNA, 1368 bp, Artificial Sequence
  source: /note="Description of Artificial Sequence: Synthetic polynucleotide"
caggtgcagttgcaggagtcgggcccaggactggtgaagccttcagagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2121 - DNA, 1368 bp, Artificial Sequence; identical to SEQ ID NO: 2120
  source: /note="Description of Artificial Sequence: Synthetic polynucleotide"

SEQ ID NO: 2122 - DNA, 1368 bp, Artificial Sequence
  source: /note="Description of Artificial Sequence: Synthetic polynucleotide"
caggtgcagttgcaggagtcgggcccaggactggtgaagccttcacagaccctgtccctcacctgcactgtctctggtgactccatcagcagtggtggttactactggagctggatccgccagcccccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2123 - DNA, 1368 bp, Artificial Sequence
  source: /note="Description of Artificial Sequence: Synthetic polynucleotide"
caggtgcagttgcaggagtcgggcccaggactggtgaagccttcagagaccctgtccctcacctgcactgtctctggtgactccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatcgtattacgatttttggagtggttatggggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2124 - DNA, 1368 bp, Artificial Sequence; identical to SEQ ID NO: 2050
  source: /note="Description of Artificial Sequence: Synthetic polynucleotide"

SEQ ID NO: 2125 - DNA, 1368 bp, Artificial Sequence; identical to SEQ ID NO: 2123
  source: /note="Description of Artificial Sequence: Synthetic polynucleotide"

SEQ ID NO: 2126 - DNA, 1368 bp, Artificial Sequence; identical to SEQ ID NO: 2122
  source: /note="Description of Artificial Sequence: Synthetic polynucleotide"

SEQ ID NO: 2127 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2128 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2129 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2130 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2131 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2132 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2133 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacagtggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2134 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcaggttcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2135 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2136 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgacgctggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2137 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggggtggatcaaccctgaaagtggtggcacagactattcacagaggtttcagggcagggtcaccatgaccagggacacgtccatcagcacagcctacatggaactgaacagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2138 - DNA, 1359 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2139 - DNA, 1359 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgacacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2140 - DNA, 1359 bp, Artificial Sequence; identical to SEQ ID NO: 2138
  source: /note="Description of Artificial Sequence: Synthetic polynucleotide"

SEQ ID NO: 2141 - DNA, 1359 bp, Artificial Sequence
  source: /note="Description of Artificial Sequence: Synthetic polynucleotide"
caggtgccgctggtacagtctggggctgaggtgaagaagcctggggcctcagtgaaggtctcctgcaaggcttctggatacaccttcaccggctactatatacactgggtgcgtcaggcccctggacaagggcttgtgtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2142 - DNA, 1359 bp, Artificial Sequence; identical to SEQ ID NO: 2048
  source: /note="Description of Artificial Sequence: Synthetic polynucleotide"

SEQ ID NO: 2143 - DNA, 1359 bp, Artificial Sequence; identical to SEQ ID NO: 2141
  source: /note="Description of Artificial Sequence: Synthetic polynucleotide"

SEQ ID NO: 2144 - DNA, 1359 bp, Artificial Sequence; identical to SEQ ID NO: 2139
  source: /note="Description of Artificial Sequence: Synthetic polynucleotide"

SEQ ID NO: 2145 - DNA, 1359 bp, Artificial Sequence
  source: /note="Description of Artificial Sequence: Synthetic polynucleotide"
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagcctgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2146 - DNA, 1359 bp, Artificial Sequence
  source: /note="Description of Artificial Sequence: Synthetic polynucleotide"
caggtgcagctggtacagtctggggctgaggtgaagaagcctggggcctcagtgaaggtctcctgcaaggcttctggatacaccttcaccggctactatatacactgggtgcgtcaggcccctggacaagggcttgagtggatggggtggatcagccctaacagtggtgaaacaagctatgcacagaagtttcaggacagggtcaccatgaccagggacacgtccatcagcacagcctatatggagctgagcagactgagatctgacgacacggccgtgtatttctgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2147 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2148 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcaggttcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2149 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgacagtggtggcacagactattcacagaggtttcagggcagggtcaccatgaccagggacacgtccatcagcacagcctacatggaactgagcaggctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2150 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatccactgggtgcgacaggcccctggacaaggacttgagtggatggggtggatcaaccctgaaagtggtggcacagactattcacagaggtttcagggcagggtcaccatgaccagggacacgtccatcagcacagcctacatggaactgagcagcctgagatctgacgacacggccgtgtattactgtgcgagagaggccacgatttttggaatggttattgtaccgtttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2151 - DNA, 1359 bp, Artificial Sequence; identical to SEQ ID NO: 2147
  source: /note="Description of Artificial Sequence: Synthetic polynucleotide"

SEQ ID NO: 2152 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2153 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2154 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2155 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2156 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgacacaaactatgcacagaagtttcaggacagggtcaccatgaccagggacacgtccatcagcacagcctatatggagctgagcaggctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2157 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgacacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2158 - DNA, 1359 bp, Artificial Sequence
  source: /note="Description of Artificial Sequence: Synthetic polynucleotide"
caggtgccgctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaacaatggtgaaacaaactatgcacagaagtttcaggacagggtcaccatgaccagggacacgtccatcagcacagcctatatggagctgagcaggctgagatctgacgacacggccgtgtattactgtacgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2159 - DNA, 1359 bp, Artificial Sequence; identical to SEQ ID NO: 2152
  source: /note="Description of Artificial Sequence: Synthetic polynucleotide"

SEQ ID NO: 2160 - DNA, 1359 bp, Artificial Sequence; identical to SEQ ID NO: 2156
  source: /note="Description of Artificial Sequence: Synthetic polynucleotide"

SEQ ID NO: 2161 - DNA, 1359 bp, Artificial Sequence; identical to SEQ ID NO: 2153
  source: /note="Description of Artificial Sequence: Synthetic polynucleotide"

SEQ ID NO: 2162 - DNA, 1359 bp, Artificial Sequence; identical to SEQ ID NO: 2155
  source: /note="Description of Artificial Sequence: Synthetic polynucleotide"

SEQ ID NO: 2163 - DNA, 1359 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatacactgggtgcgtcaggcccctggacaagggcttgagtggatggggtggataagccctaaccaaggtgaaacaaactatgcacagaagtttcaggacagggtcaccatgaccagggacacgtccatcagcacagcctatatggagctgagcagcctgagatctgacgacacggccgtgtattactgtgcgagagaggccacgatttttggaatgcttattgtaccatttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2164 - DNA, 1359 bp, Artificial Sequence; identical to SEQ ID NO: 2163
  source: /note="Description of Artificial Sequence: Synthetic polynucleotide"

SEQ ID NO: 2165 - DNA, 1374 bp, Artificial Sequence; identical to SEQ ID NO: 2042
  source: /note="Description of Artificial Sequence: Synthetic polynucleotide"

SEQ ID NO: 2166 - DNA, 1374 bp, Artificial Sequence; identical to SEQ ID NO: 2042
  source: /note="Description of Artificial Sequence: Synthetic polynucleotide"

SEQ ID NO: 2167 - DNA, 1374 bp, Artificial Sequence; identical to SEQ ID NO: 2042
  source: /note="Description of Artificial Sequence: Synthetic polynucleotide"

SEQ ID NO: 2168 - DNA, 1374 bp, Artificial Sequence; identical to SEQ ID NO: 2042
  source: /note="Description of Artificial Sequence: Synthetic polynucleotide"

SEQ ID NO: 2169 - DNA, 1374 bp, Artificial Sequence; identical to SEQ ID NO: 2042
  source: /note="Description of Artificial Sequence: Synthetic polynucleotide"

SEQ ID NO: 2170 - DNA, 1374 bp, Artificial Sequence; identical to SEQ ID NO: 2042
  source: /note="Description of Artificial Sequence: Synthetic polynucleotide"

SEQ ID NO: 2171 - DNA, 1374 bp, Artificial Sequence; identical to SEQ ID NO: 2042
  source: /note="Description of Artificial Sequence: Synthetic polynucleotide"

SEQ ID NO: 2172 - DNA, 1374 bp, Artificial Sequence; identical to SEQ ID NO: 2042
  source: /note="Description of Artificial Sequence: Synthetic polynucleotide"

SEQ ID NO: 2173 - DNA, 1374 bp, Artificial Sequence; identical to SEQ ID NO: 2042
  source: /note="Description of Artificial Sequence: Synthetic polynucleotide"

SEQ ID NO: 2174 - DNA, 1374 bp, Artificial Sequence; identical to SEQ ID NO: 2042
  source: /note="Description of Artificial Sequence: Synthetic polynucleotide"

SEQ ID NO: 2175 - DNA, 1374 bp, Artificial Sequence; identical to SEQ ID NO: 2042
  source: /note="Description of Artificial Sequence: Synthetic polynucleotide"

SEQ ID NO: 2176 - DNA, 1374 bp, Artificial Sequence; identical to SEQ ID NO: 2042
  source: /note="Description of Artificial Sequence: Synthetic polynucleotide"

SEQ ID NO: 2177 - DNA, 1374 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcagcctgaggtctgacgacacggccgtgtattactgtgcgagagggggggattacgttttcgggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2178 - DNA, 1374 bp, Artificial Sequence
  source: /note="Description of Artificial Sequence: Synthetic polynucleotide"
cagatgcaggtggtgcagtctggggctgaggtgaagaagcctggggcctcagtgaaggtctcctgcaaggcttccggatacaccttcaccggctactatatgcattgggtgcgacaggcccctggacaagggcttgagtggatgggatggatcaaccctaacagtggtggcacaaactatgcacagaagtttcagggcagggtcaccatgaccagggacacgtccatcagtacagcctacatggagctgagcaggctgaggtctgacgacacggccgtgtattactgtgcgagagggggggattacgttttcgggacttatcggcctcactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2179 - DNA, 1353 bp, Artificial Sequence; identical to SEQ ID NO: 2079
  source: /note="Description of Artificial Sequence: Synthetic polynucleotide"

SEQ ID NO: 2180 - DNA, 1353 bp, Artificial Sequence; identical to SEQ ID NO: 2061
  source: /note="Description of Artificial Sequence: Synthetic polynucleotide"

SEQ ID NO: 2181 - DNA, 1374 bp, Artificial Sequence; identical to SEQ ID NO: 2042
  source: /note="Description of Artificial Sequence: Synthetic polynucleotide"

SEQ ID NO: 2182 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatggaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2183 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2184 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2185 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtacagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2186 - DNA, 1353 bp, Artificial Sequence; identical to SEQ ID NO: 2184
  source: /note="Description of Artificial Sequence: Synthetic polynucleotide"

SEQ ID NO: 2187 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacattggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2188 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgcaagtaataagttccatgcagactccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2189 - DNA, 1353 bp, Artificial Sequence
  source: /note="Description of Artificial Sequence: Synthetic polynucleotide"
caggtgcagttggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataagttccatgcagacgccgtgaagggccgattcaccatctccagagacaattccaagaacacgctgtatctgcaaatgaacagcctgagagccgaggactcggctatgtacttctgtgcgagaggaaaagtggctggtatgcctgaagcttttgaaatctggggccaagggacaaaggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2190 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2191 - DNA, 1377 bp, Artificial Sequence; identical to SEQ ID NO: 2183
  source: /note="Description of Artificial Sequence: Synthetic polynucleotide"

SEQ ID NO: 2192 - DNA, 1377 bp, Artificial Sequence; identical to SEQ ID NO: 2190
  source: /note="Description of Artificial Sequence: Synthetic polynucleotide"

SEQ ID NO: 2193 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2194 - DNA, 1377 bp, Artificial Sequence; identical to SEQ ID NO: 2190
  source: /note="Description of Artificial Sequence: Synthetic polynucleotide"

SEQ ID NO: 2195 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtaacacaggctatgcacagaagttccagggcagagtcaccatgaccagggacacctccataagcacagcctacatggagctgagcagcctgagatctgacgacacggccgtgtattactgtgcgagagggggtgattacgtttgggggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2196 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtggcacaggctatgcacagaagttccagggcagagtcaccatgaccagggacacctccataagcacagcctacatggagctgagcagcctgagatctcaggacacggccgtgtattactgtgcgagagggggtgattacgttttcgggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2197 - DNA, 1377 bp, Artificial Sequence
  source: /note="Description of Artificial Sequence: Synthetic polynucleotide"
caaatgcagctggtgcagtctggggctgaggtgaagaagcctggggcctcagtgaaggtctcctgcaaggcttctggatacaccttcaccagttatgatatcaactgggtgcgacaggcccctggacaagggcttgagtggatgggatggatgaaccctaacagtggtggcacaggctatgcacagaagttccagggcagagtcaccatgaccagggacacctccataagcacagcctacatggagctgagcagcctgagatctgacgacacggccgtgtattactgtgcgagagggggtgattacgttttcgggagttatcgtccctactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2198 - DNA, 1353 bp, Artificial Sequence; identical to SEQ ID NO: 2187
  source: /note="Description of Artificial Sequence: Synthetic polynucleotide"

SEQ ID NO: 2199 - DNA, 39 bp, Artificial Sequence
  source: /note="Description of Artificial Sequence: Synthetic oligonucleotide"
tctggaagtagctccaacatcggaagtaatactgtaaac

SEQ ID NO: 2200 - DNA, 33 bp, Artificial Sequence
  source: /note="Description of Artificial Sequence: Synthetic oligonucleotide"
cgggcaagtcaggacattagagattatttaggc

SEQ ID NO: 2201 - DNA, 33 bp, Artificial Sequence; identical to SEQ ID NO: 2200
  source: /note="Description of Artificial Sequence: Synthetic oligonucleotide"

SEQ ID NO: 2202 - DNA, 33 bp, Artificial Sequence
  source: /note="Description of Artificial Sequence: Synthetic oligonucleotide"
caggcgagtcaggacattagcaactatttaaat

SEQ ID NO: 2203 - DNA, 51 bp, Artificial Sequence
  source: /note="Description of Artificial Sequence: Synthetic oligonucleotide"
aagtccagccagagtgttttatccagctccaacaataagaactacatagct

SEQ ID NO: 2204 - DNA, 51 bp, Artificial Sequence; identical to SEQ ID NO: 2203
  source: /note="Description of Artificial Sequence: Synthetic oligonucleotide"

SEQ ID NO: 2205 - DNA, 51 bp, Artificial Sequence
  source: /note="Description of Artificial Sequence: Synthetic oligonucleotide"
aagtccagccagagtgttttatccagctccaacaataagaactacttagct

SEQ ID NO: 2206 - DNA, 51 bp, Artificial Sequence; identical to SEQ ID NO: 2205
  source: /note="Description of Artificial Sequence: Synthetic oligonucleotide"

SEQ ID NO: 2207 - DNA, 36 bp, Artificial Sequence
  source: /note="Description of Artificial Sequence: Synthetic oligonucleotide"
agggccagtcagagtattagttacagttacttagcc

SEQ ID NO: 2208 - DNA, 33 bp, Artificial Sequence
  source: /note="Description of Artificial Sequence: Synthetic oligonucleotide"
agggccagtcagagtgttagcagcaacttagcc

SEQ ID NO: 2209 - DNA, 33 bp, Artificial Sequence
  source: /note="Description of Artificial Sequence: Synthetic oligonucleotide"
cgggcaagtcagggcattagaaatgagttaggc

SEQ ID NO: 2210 - DNA, 33 bp, Artificial Sequence
  source: /note="Description of Artificial Sequence: Synthetic oligonucleotide"
caggcgagtcaggacattaccaactatttaaat

SEQ ID NO: 2211 - DNA, 33 bp, Artificial Sequence
  source: /note="Description of Artificial Sequence: Synthetic oligonucleotide"
cgggcgagtcagggtcttatcatctggttagcc

SEQ ID NO: 2212 - DNA, 33 bp, Artificial Sequence; identical to SEQ ID NO: 2211
  source: /note="Description of Artificial Sequence: Synthetic oligonucleotide"

SEQ ID NO: 2213 - DNA, 33 bp, Artificial Sequence; identical to SEQ ID NO: 2209
  source: /note="Description of Artificial Sequence: Synthetic oligonucleotide"

SEQ ID NO: 2214 - DNA, 33 bp, Artificial Sequence; identical to SEQ ID NO: 2209
  source: /note="Description of Artificial Sequence: Synthetic oligonucleotide"

SEQ ID NO: 2215 - DNA, 33 bp, Artificial Sequence; identical to SEQ ID NO: 2209
  source: /note="Description of Artificial Sequence: Synthetic oligonucleotide"

SEQ ID NO: 2216 - DNA, 33 bp, Artificial Sequence; identical to SEQ ID NO: 2209
  source: /note="Description of Artificial Sequence: Synthetic oligonucleotide"

SEQ ID NO: 2217 - DNA, 33 bp, Artificial Sequence; identical to SEQ ID NO: 2209
  source: /note="Description of Artificial Sequence: Synthetic oligonucleotide"

SEQ ID NO: 2218 - DNA, 33 bp, Artificial Sequence; identical to SEQ ID NO: 2209
  source: /note="Description of Artificial Sequence: Synthetic oligonucleotide"

SEQ ID NO: 2219 - DNA, 33 bp, Artificial Sequence; identical to SEQ ID NO: 2200
  source: /note="Description of Artificial Sequence: Synthetic oligonucleotide"

SEQ ID NO: 2220 - DNA, 33 bp, Artificial Sequence; identical to SEQ ID NO: 2200
  source: /note="Description of Artificial Sequence: Synthetic oligonucleotide"

SEQ ID NO: 2221 - DNA, 33 bp, Artificial Sequence; identical to SEQ ID NO: 2200
  source: /note="Description of Artificial Sequence: Synthetic oligonucleotide"

SEQ ID NO: 2222 - DNA, 33 bp, Artificial Sequence; identical to SEQ ID NO: 2200
  source: /note="Description of Artificial Sequence: Synthetic oligonucleotide"

SEQ ID NO: 2223 - DNA, 33 bp, Artificial Sequence; identical to SEQ ID NO: 2200
  source: /note="Description of Artificial Sequence: Synthetic oligonucleotide"

SEQ ID NO: 2224 - DNA, 33 bp, Artificial Sequence; identical to SEQ ID NO: 2200
  source: /note="Description of Artificial Sequence: Synthetic oligonucleotide"

SEQ ID NO: 2225 - DNA, 33 bp, Artificial Sequence; identical to SEQ ID NO: 2200
  source: /note="Description of Artificial Sequence: Synthetic oligonucleotide"

SEQ ID NO: 2226 - DNA, 33 bp, Artificial Sequence
  source: /note="Description of Artificial Sequence: Synthetic oligonucleotide"
cgggcaagtcaggaccttagaaattatttaggc

SEQ ID NO: 2227 - DNA, 33 bp, Artificial Sequence; identical to SEQ ID NO: 2226
  source: /note="Description of Artificial Sequence: Synthetic oligonucleotide"

SEQ ID NO: 2228 - DNA, 33 bp, Artificial Sequence; identical to SEQ ID NO: 2226
  source: /note="Description of Artificial Sequence: Synthetic oligonucleotide"

SEQ ID NO: 2229 - DNA, 33 bp, Artificial Sequence; identical to SEQ ID NO: 2226
  source: /note="Description of Artificial Sequence: Synthetic oligonucleotide"

SEQ ID NO: 2230 - DNA, 33 bp, Artificial Sequence; identical to SEQ ID NO: 2226
  source: /note="Description of Artificial Sequence: Synthetic oligonucleotide"

SEQ ID NO: 2231 - DNA, 33 bp, Artificial Sequence; identical to SEQ ID NO: 2226
  source: /note="Description of Artificial Sequence: Synthetic oligonucleotide"

SEQ ID NO: 2232 - DNA, 33 bp, Artificial Sequence; identical to SEQ ID NO: 2226
  source: /note="Description of Artificial Sequence: Synthetic oligonucleotide"

SEQ ID NO: 2233 - DNA, 33 bp, Artificial Sequence; identical to SEQ ID NO: 2226
  source: /note="Description of Artificial Sequence: Synthetic oligonucleotide"

SEQ ID NO: 2234 - DNA, 33 bp, Artificial Sequence; identical to SEQ ID NO: 2226
  source: /note="Description of Artificial Sequence: Synthetic oligonucleotide"

SEQ ID NO: 2235 - DNA, 33 bp, Artificial Sequence; identical to SEQ ID NO: 2226
  source: /note="Description of Artificial Sequence: Synthetic oligonucleotide"

SEQ ID NO: 2236 - DNA, 33 bp, Artificial Sequence; identical to SEQ ID NO: 2226
  source: /note="Description of Artificial Sequence: Synthetic oligonucleotide"

SEQ ID NO: 2237 - DNA, 33 bp, Artificial Sequence; identical to SEQ ID NO: 2226
  source: /note="Description of Artificial Sequence: Synthetic oligonucleotide"

SEQ ID NO: 2238 - DNA, 33 bp, Artificial Sequence; identical to SEQ ID NO: 2202
  source: /note="Description of Artificial Sequence: Synthetic oligonucleotide"

SEQ ID NO: 2239 - DNA, 33 bp, Artificial Sequence; identical to SEQ ID NO: 2202
  source: /note="Description of Artificial Sequence: Synthetic oligonucleotide"

SEQ ID NO: 2240 - DNA, 33 bp, Artificial Sequence; identical to SEQ ID NO: 2202
  source: /note="Description of Artificial Sequence: Synthetic oligonucleotide"

SEQ ID NO: 2241 - DNA, 33 bp, Artificial Sequence; identical to SEQ ID NO: 2202
  source: /note="Description of Artificial Sequence: Synthetic oligonucleotide"

SEQ ID NO: 2242 - DNA, 33 bp, Artificial Sequence; identical to SEQ ID NO: 2202
  source: /note="Description of Artificial Sequence: Synthetic oligonucleotide"

SEQ ID NO: 2243 - DNA, 33 bp, Artificial Sequence; identical to SEQ ID NO: 2202
  source: /note="Description of Artificial Sequence: Synthetic oligonucleotide"

SEQ ID NO: 2244 - DNA, 33 bp, Artificial Sequence; identical to SEQ ID NO: 2202
  source: /note="Description of Artificial Sequence: Synthetic oligonucleotide"

SEQ ID NO: 2245 - DNA, 33 bp, Artificial Sequence; identical to SEQ ID NO: 2202
  source: /note="Description of Artificial Sequence: Synthetic oligonucleotide"

SEQ ID NO: 2246 - DNA, 33 bp, Artificial Sequence; identical to SEQ ID NO: 2202
  source: /note="Description of Artificial Sequence: Synthetic oligonucleotide"

SEQ ID NO: 2247 - DNA, 33 bp, Artificial Sequence; identical to SEQ ID NO: 2200
  source: /note="Description of Artificial Sequence: Synthetic oligonucleotide"

SEQ ID NO: 2248 - DNA, 33 bp, Artificial Sequence; identical to SEQ ID NO: 2200
  source: /note="Description of Artificial Sequence: Synthetic oligonucleotide"

SEQ ID NO: 2249 - DNA, 33 bp, Artificial Sequence; identical to SEQ ID NO: 2200
  source: /note="Description of Artificial Sequence: Synthetic oligonucleotide"

SEQ ID NO: 2250 - DNA, 33 bp, Artificial Sequence; identical to SEQ ID NO: 2200
  source: /note="Description of Artificial Sequence: Synthetic oligonucleotide"

SEQ ID NO: 2251 - DNA, 33 bp, Artificial Sequence; identical to SEQ ID NO: 2200
  source: /note="Description of Artificial Sequence: Synthetic oligonucleotide"

SEQ ID NO: 2252 - DNA, 33 bp, Artificial Sequence; identical to SEQ ID NO: 2200
  source: /note="Description of Artificial Sequence: Synthetic oligonucleotide"

SEQ ID NO: 2253 - DNA, 33 bp, Artificial Sequence; identical to SEQ ID NO: 2200
  source: /note="Description of Artificial Sequence: Synthetic oligonucleotide"

SEQ ID NO: 2254 - DNA, 33 bp, Artificial Sequence; identical to SEQ ID NO: 2210
  source: /note="Description of Artificial Sequence: Synthetic oligonucleotide"

SEQ ID NO: 2255 - DNA, 33 bp, Artificial Sequence; identical to SEQ ID NO: 2210
  source: /note="Description of Artificial Sequence: Synthetic oligonucleotide"

SEQ ID NO: 2256 - DNA, 33 bp, Artificial Sequence; identical to SEQ ID NO: 2210
  source: /note="Description of Artificial Sequence: Synthetic oligonucleotide"

SEQ ID NO: 2257 - DNA, 33 bp, Artificial Sequence; identical to SEQ ID NO: 2210
  source: /note="Description of Artificial Sequence: Synthetic oligonucleotide"

SEQ ID NO: 2258 - DNA, 33 bp, Artificial Sequence; identical to SEQ ID NO: 2210
  source: /note="Description of Artificial Sequence: Synthetic oligonucleotide"

SEQ ID NO: 2259 - DNA, 33 bp, Artificial Sequence; identical to SEQ ID NO: 2210
  source: /note="Description of Artificial Sequence: Synthetic oligonucleotide"

SEQ ID NO: 2260 - DNA, 33 bp, Artificial Sequence; identical to SEQ ID NO: 2210
  source: /note="Description of Artificial Sequence: Synthetic oligonucleotide"

SEQ ID NO: 2261 - DNA, 33 bp, Artificial Sequence; identical to SEQ ID NO: 2210
  source: /note="Description of Artificial Sequence: Synthetic oligonucleotide"

SEQ ID NO: 2262 - DNA, 33 bp, Artificial Sequence; identical to SEQ ID NO: 2210
  source: /note="Description of Artificial Sequence: Synthetic oligonucleotide"

SEQ ID NO: 2263 - DNA, 33 bp, Artificial Sequence; identical to SEQ ID NO: 2210
  source: /note="Description of Artificial Sequence: Synthetic oligonucleotide"

SEQ ID NO: 2264 - DNA, 33 bp, Artificial Sequence; identical to SEQ ID NO: 2210
  source: /note="Description of Artificial Sequence: Synthetic oligonucleotide"

SEQ ID NO: 2265 - DNA, 36 bp, Artificial Sequence
  source: /note="Description of Artificial Sequence: Synthetic oligonucleotide"
agggccagtcagatttttaccagcacctacttagcc

SEQ ID NO: 2266 - DNA, 36 bp, Artificial Sequence; identical to SEQ ID NO: 2265
  source: /note="Description of Artificial Sequence: Synthetic oligonucleotide"

SEQ ID NO: 2267 - DNA, 36 bp, Artificial Sequence; identical to SEQ ID NO: 2265
  source: /note="Description of Artificial Sequence: Synthetic oligonucleotide"

SEQ ID NO: 2268 - DNA, 36 bp, Artificial Sequence; identical to SEQ ID NO: 2265
  source: /note="Description of Artificial Sequence: Synthetic oligonucleotide"

SEQ ID NO: 2269 - DNA, 33 bp, Artificial Sequence; identical to SEQ ID NO: 2208
  source: /note="Description of Artificial Sequence: Synthetic oligonucleotide"

SEQ ID NO: 2270 - DNA, 33 bp, Artificial Sequence; identical to SEQ ID NO: 2208
  source: /note="Description of Artificial Sequence: Synthetic oligonucleotide"

SEQ ID NO: 2271 - DNA, 33 bp, Artificial Sequence; identical to SEQ ID NO: 2208
  source: /note="Description of Artificial Sequence: Synthetic oligonucleotide"

SEQ ID NO: 2272 - DNA, 33 bp, Artificial Sequence; identical to SEQ ID NO: 2208
  source: /note="Description of Artificial Sequence: Synthetic oligonucleotide"

SEQ ID NO: 2273 - DNA, 33 bp, Artificial Sequence; identical to SEQ ID NO: 2208
  source: /note="Description of Artificial Sequence: Synthetic oligonucleotide"

SEQ ID NO: 2274 - DNA, 33 bp, Artificial Sequence; identical to SEQ ID NO: 2208
  source: /note="Description of Artificial Sequence: Synthetic oligonucleotide"

SEQ ID NO: 2275 - DNA, 33 bp, Artificial Sequence; identical to SEQ ID NO: 2208
  source: /note="Description of Artificial Sequence: Synthetic oligonucleotide"

SEQ ID NO: 2276 - DNA, 33 bp, Artificial Sequence; identical to SEQ ID NO: 2208
  source: /note="Description of Artificial Sequence: Synthetic oligonucleotide"

SEQ ID NO: 2277 - DNA, 36 bp, Artificial Sequence; identical to SEQ ID NO: 2207
  source: /note="Description of Artificial Sequence: Synthetic oligonucleotide"

SEQ ID NO: 2278 - DNA, 36 bp, Artificial Sequence; identical to SEQ ID NO: 2207
  source: /note="Description of Artificial Sequence: Synthetic oligonucleotide"

SEQ ID NO: 2279 - DNA, 36 bp, Artificial Sequence; identical to SEQ ID NO: 2207
  source: /note="Description of Artificial Sequence: Synthetic oligonucleotide"

SEQ ID NO: 2280 - DNA, 36 bp, Artificial Sequence; identical to SEQ ID NO: 2207
  source: /note="Description of Artificial Sequence: Synthetic oligonucleotide"

SEQ ID NO: 2281 - DNA, 36 bp, Artificial Sequence; identical to SEQ ID NO: 2207
  source: /note="Description of Artificial Sequence: Synthetic oligonucleotide"

SEQ ID NO: 2282 - DNA, 36 bp, Artificial Sequence; identical to SEQ ID NO: 2207
  source: /note="Description of Artificial Sequence: Synthetic oligonucleotide"

SEQ ID NO: 2283 - DNA, 36 bp, Artificial Sequence; identical to SEQ ID NO: 2207
  source: /note="Description of Artificial Sequence: Synthetic oligonucleotide"

SEQ ID NO: 2284 - DNA, 51 bp, Artificial Sequence; identical to SEQ ID NO: 2203
  source: /note="Description of Artificial Sequence: Synthetic oligonucleotide"

SEQ ID NO: 2285 - DNA, 51 bp, Artificial Sequence; identical to SEQ ID NO: 2203
  source: /note="Description of Artificial Sequence: Synthetic oligonucleotide"

SEQ ID NO: 2286 - DNA, 51 bp, Artificial Sequence; identical to SEQ ID NO: 2203
  source: /note="Description of Artificial Sequence: Synthetic oligonucleotide"

SEQ ID NO: 2287 - DNA, 51 bp, Artificial Sequence; identical to SEQ ID NO: 2203
  source: /note="Description of Artificial Sequence: Synthetic oligonucleotide"

SEQ ID NO: 2288 - DNA, 51 bp, Artificial Sequence; identical to SEQ ID NO: 2203
  source: /note="Description of Artificial Sequence: Synthetic oligonucleotide"

SEQ ID NO: 2289 - DNA, 51 bp, Artificial Sequence; identical to SEQ ID NO: 2203
  source: /note="Description of Artificial Sequence: Synthetic oligonucleotide"

SEQ ID NO: 2290 - DNA, 51 bp, Artificial Sequence; identical to SEQ ID NO: 2203
  source: /note="Description of Artificial Sequence: Synthetic oligonucleotide"

SEQ ID NO: 2291 - DNA, 51 bp, Artificial Sequence; identical to SEQ ID NO: 2203
  source: /note="Description of Artificial Sequence: Synthetic oligonucleotide"

SEQ ID NO: 2292 - DNA, 51 bp, Artificial Sequence; identical to SEQ ID NO: 2203
  source: /note="Description of Artificial Sequence: Synthetic oligonucleotide"

SEQ ID NO: 2293 - DNA, 51 bp, Artificial Sequence; identical to SEQ ID NO: 2203
  source: /note="Description of Artificial Sequence: Synthetic oligonucleotide"

SEQ ID NO: 2294 - DNA, 51 bp, Artificial Sequence; identical to SEQ ID NO: 2203
  source: /note="Description of Artificial Sequence: Synthetic oligonucleotide"

SEQ ID NO: 2295 - DNA, 51 bp, Artificial Sequence; identical to SEQ ID NO: 2205
  source: /note="Description of Artificial Sequence: Synthetic oligonucleotide"

SEQ ID NO: 2296 - DNA, 51 bp, Artificial Sequence; identical to SEQ ID NO: 2205
  source: /note="Description of Artificial Sequence: Synthetic oligonucleotide"

SEQ ID NO: 2297 - DNA, 51 bp, Artificial Sequence; identical to SEQ ID NO: 2205
  source: /note="Description of Artificial Sequence: Synthetic oligonucleotide"

SEQ ID NO: 2298 - DNA, 51 bp, Artificial Sequence; identical to SEQ ID NO: 2205
  source: /note="Description of Artificial Sequence: Synthetic oligonucleotide"

SEQ ID NO: 2299 - DNA, 51 bp, Artificial Sequence; identical to SEQ ID NO: 2205
  source: /note="Description of Artificial Sequence: Synthetic oligonucleotide"

SEQ ID NO: 2300 - DNA, 51 bp, Artificial Sequence; identical to SEQ ID NO: 2205
  source: /note="Description of Artificial Sequence: Synthetic oligonucleotide"

SEQ ID NO: 2301 - DNA, 51 bp, Artificial Sequence; identical to SEQ ID NO: 2205
  source: /note="Description of Artificial Sequence: Synthetic oligonucleotide"

SEQ ID NO: 2302 - DNA, 51 bp, Artificial Sequence; identical to SEQ ID NO: 2205
  source: /note="Description of Artificial Sequence: Synthetic oligonucleotide"

SEQ ID NO: 2303 - DNA, 51 bp, Artificial Sequence; identical to SEQ ID NO: 2205
  source: /note="Description of Artificial Sequence: Synthetic oligonucleotide"

SEQ ID NO: 2304 - DNA, 51 bp, Artificial Sequence; identical to SEQ ID NO: 2203
  source: /note="Description of Artificial Sequence: Synthetic oligonucleotide"

SEQ ID NO: 2305 - DNA, 51 bp, Artificial Sequence; identical to SEQ ID NO: 2203
  source: /note="Description of Artificial Sequence: Synthetic oligonucleotide"

SEQ ID NO: 2306 - DNA, 51 bp, Artificial Sequence; identical to SEQ ID NO: 2203
  source: /note="Description of Artificial Sequence: Synthetic oligonucleotide"

SEQ ID NO: 2307 - DNA, 51 bp, Artificial Sequence; identical to SEQ ID NO: 2203
  source: /note="Description of Artificial Sequence: Synthetic oligonucleotide"

SEQ ID NO: 2308 - DNA, 51 bp, Artificial Sequence; identical to SEQ ID NO: 2203
  source: /note="Description of Artificial Sequence: Synthetic oligonucleotide"

SEQ ID NO: 2309 - DNA, 51 bp, Artificial Sequence; identical to SEQ ID NO: 2205
  source: /note="Description of Artificial Sequence: Synthetic oligonucleotide"

SEQ ID NO: 2310 - DNA, 51 bp, Artificial Sequence; identical to SEQ ID NO: 2205
  source: /note="Description of Artificial Sequence: Synthetic oligonucleotide"

SEQ ID NO: 2311 - DNA, 51 bp, Artificial Sequence; identical to SEQ ID NO: 2205
  source: /note="Description of Artificial Sequence: Synthetic oligonucleotide"

SEQ ID NO: 2312 - DNA, 51 bp, Artificial Sequence; identical to SEQ ID NO: 2205
  source: /note="Description of Artificial Sequence: Synthetic oligonucleotide"

SEQ ID NO: 2313 - DNA, 51 bp, Artificial Sequence; identical to SEQ ID NO: 2205
  source: /note="Description of Artificial Sequence: Synthetic oligonucleotide"

SEQ ID NO: 2314 - DNA, 51 bp, Artificial Sequence; identical to SEQ ID NO: 2205
  source: /note="Description of Artificial Sequence: Synthetic oligonucleotide"

SEQ ID NO: 2315 - DNA, 51 bp, Artificial Sequence; identical to SEQ ID NO: 2205
  source: /note="Description of Artificial Sequence: Synthetic oligonucleotide"

SEQ ID NO: 2316 - DNA, 51 bp, Artificial Sequence; identical to SEQ ID NO: 2205
  source: /note="Description of Artificial Sequence: Synthetic oligonucleotide"

SEQ ID NO: 2317 - DNA, 51 bp, Artificial Sequence; identical to SEQ ID NO: 2205
  source: /note="Description of Artificial Sequence: Synthetic oligonucleotide"

SEQ ID NO: 2318 - DNA, 51 bp, Artificial Sequence; identical to SEQ ID NO: 2205
  source: /note="Description of Artificial Sequence: Synthetic oligonucleotide"

SEQ ID NO: 2319 - DNA, 51 bp, Artificial Sequence; identical to SEQ ID NO: 2205
  source: /note="Description of Artificial Sequence: Synthetic oligonucleotide"

SEQ ID NO: 2320 - DNA, 51 bp, Artificial Sequence; identical to SEQ ID NO: 2205
  source: /note="Description of Artificial Sequence: Synthetic oligonucleotide"

SEQ ID NO: 2321 - DNA, 51 bp, Artificial Sequence; identical to SEQ ID NO: 2205
  source: /note="Description of Artificial Sequence: Synthetic oligonucleotide"

SEQ ID NO: 2322 - DNA, 39 bp, Artificial Sequence
  source: /note="Description of Artificial Sequence: Synthetic oligonucleotide"
tctggaagtagctccaacatcggaagtcaaactgtaaac

SEQ ID NO: 2323 - DNA, 39 bp, Artificial Sequence; identical to SEQ ID NO: 2322
  source: /note="Description of Artificial Sequence: Synthetic oligonucleotide"

SEQ ID NO: 2324 - DNA, 39 bp, Artificial Sequence
  source: /note="Description of Artificial Sequence: Synthetic oligonucleotide"
tctggaagtagctccaacatcggaagtaattatgtaaac

SEQ ID NO: 2325 - DNA, 39 bp, Artificial Sequence; identical to SEQ ID NO: 2324
  source: /note="Description of Artificial Sequence: Synthetic oligonucleotide"

SEQ ID NO: 2326 - DNA, 39 bp, Artificial Sequence; identical to SEQ ID NO: 2322
  source: /note="Description of Artificial Sequence: Synthetic oligonucleotide"

SEQ ID NO: 2327 - DNA, 39 bp, Artificial Sequence; identical to SEQ ID NO: 2324
  source: /note="Description of Artificial Sequence: Synthetic oligonucleotide"

SEQ ID NO: 2328 - DNA, 39 bp, Artificial Sequence; identical to SEQ ID NO: 2199
  source: /note="Description of Artificial Sequence: Synthetic oligonucleotide"

SEQ ID NO: 2329 - DNA, 39 bp, Artificial Sequence; identical to SEQ ID NO: 2199
  source: /note="Description of Artificial Sequence: Synthetic oligonucleotide"

SEQ ID NO: 2330 - DNA, 39 bp, Artificial Sequence; identical to SEQ ID NO: 2199
  source: /note="Description of Artificial Sequence: Synthetic oligonucleotide"

SEQ ID NO: 2331 - DNA, 39 bp, Artificial Sequence; identical to SEQ ID NO: 2199
  source: /note="Description of Artificial Sequence: Synthetic oligonucleotide"

SEQ ID NO: 2332 - DNA, 39 bp, Artificial Sequence; identical to SEQ ID NO: 2199
  source: /note="Description of Artificial Sequence: Synthetic oligonucleotide"

SEQ ID NO: 2333 - DNA, 39 bp, Artificial Sequence; identical to SEQ ID NO: 2324
  source: /note="Description of Artificial Sequence: Synthetic oligonucleotide"

SEQ ID NO: 2334 - DNA, 39 bp, Artificial Sequence; identical to SEQ ID NO: 2324
  source: /note="Description of Artificial Sequence: Synthetic oligonucleotide"

SEQ ID NO: 2335 - DNA, 39 bp, Artificial Sequence; identical to SEQ ID NO: 2322
  source: /note="Description of Artificial Sequence: Synthetic oligonucleotide"

SEQ ID NO: 2336 - DNA, 33 bp, Artificial Sequence; identical to SEQ ID NO: 2226
  source: /note="Description of Artificial Sequence: Synthetic oligonucleotide"

SEQ ID NO: 2337 - DNA, 33 bp, Artificial Sequence; identical to SEQ ID NO: 2200
  source: /note="Description of Artificial Sequence: Synthetic oligonucleotide"

SEQ ID NO: 2338 - DNA, 39 bp, Artificial Sequence; identical to SEQ ID NO: 2199
  source: /note="Description of Artificial Sequence: Synthetic oligonucleotide"

SEQ ID NO: 2339 - DNA, 33 bp, Artificial Sequence
  source: /note="Description of Artificial Sequence: Synthetic oligonucleotide"
cgggcaagtcagaccattagcaggtttttaaat

SEQ ID NO: 2340 - DNA, 39 bp, Artificial Sequence
  source: /note="Description of Artificial Sequence: Synthetic oligonucleotide"
tctggaagcagctccaacattggaaataattatgtatcc

SEQ ID NO: 2341 - DNA, 33 bp, Artificial Sequence; identical to SEQ ID NO: 2339
  source: /note="Description of Artificial Sequence: Synthetic oligonucleotide"

SEQ ID NO: 2342 - DNA, 33 bp, Artificial Sequence; identical to SEQ ID NO: 2339
  source: /note="Description of Artificial Sequence: Synthetic oligonucleotide"

SEQ ID NO: 2343 - DNA, 33 bp, Artificial Sequence; identical to SEQ ID NO: 2339
  source: /note="Description of Artificial Sequence: Synthetic oligonucleotide"

SEQ ID NO: 2344 - DNA, 33 bp, Artificial Sequence; identical to SEQ ID NO: 2339
  source: /note="Description of Artificial Sequence: Synthetic oligonucleotide"

SEQ ID NO: 2345 - DNA, 33 bp, Artificial Sequence; identical to SEQ ID NO: 2339
  source: /note="Description of Artificial Sequence: Synthetic oligonucleotide"

SEQ ID NO: 2346 - DNA, 33 bp, Artificial Sequence; identical to SEQ ID NO: 2339
  source: /note="Description of Artificial Sequence: Synthetic oligonucleotide"

SEQ ID NO: 2347 - DNA, 39 bp, Artificial Sequence; identical to SEQ ID NO: 2340
  source: /note="Description of Artificial Sequence: Synthetic oligonucleotide"

SEQ ID NO: 2348 - DNA, 39 bp, Artificial Sequence; identical to SEQ ID NO: 2340
  source: /note="Description of Artificial Sequence: Synthetic oligonucleotide"

SEQ ID NO: 2349 - DNA, 39 bp, Artificial Sequence; identical to SEQ ID NO: 2340
  source: /note="Description of Artificial Sequence: Synthetic oligonucleotide"

SEQ ID NO: 2350 - DNA, 39 bp, Artificial Sequence; identical to SEQ ID NO: 2340
  source: /note="Description of Artificial Sequence: Synthetic oligonucleotide"

SEQ ID NO: 2351 - DNA, 39 bp, Artificial Sequence; identical to SEQ ID NO: 2340
  source: /note="Description of Artificial Sequence: Synthetic oligonucleotide"

SEQ ID NO: 2352 - DNA, 39 bp, Artificial Sequence; identical to SEQ ID NO: 2340
  source: /note="Description of Artificial Sequence: Synthetic oligonucleotide"

SEQ ID NO: 2353 - DNA, 39 bp, Artificial Sequence; identical to SEQ ID NO: 2340
  source: /note="Description of Artificial Sequence: Synthetic oligonucleotide"

SEQ ID NO: 2354 - DNA, 39 bp, Artificial Sequence; identical to SEQ ID NO: 2340
  source: /note="Description of Artificial Sequence: Synthetic oligonucleotide"

SEQ ID NO: 2355 - DNA, 33 bp, Artificial Sequence; identical to SEQ ID NO: 2339
  source: /note="Description of Artificial Sequence: Synthetic oligonucleotide"

SEQ ID NO: 2356 - DNA, 21 bp, Artificial Sequence
  source: /note="Description of Artificial Sequence: Synthetic oligonucleotide"
actaataatcagcggccctca

SEQ ID NO: 2357 - DNA, 21 bp, Artificial Sequence
  source: /note="Description of Artificial Sequence: Synthetic oligonucleotide"
ggtgcatccagtttgcaaagt

SEQ ID NO: 2358 - DNA, 21 bp, Artificial Sequence
  source: /note="Description of Artificial Sequence: Synthetic oligonucleotide"
ggtgcatccagtttgcaaagt

SEQ ID NO: 2359 - DNA, 21 bp, Artificial Sequence
  source: /note="Description of Artificial Sequence: Synthetic oligonucleotide"
gatgcatccaatttggaaaca

SEQ ID NO: 2360 - DNA, 21 bp, Artificial Sequence
  source: /note="Description of Artificial Sequence: Synthetic oligonucleotide"
tgggcatctacccgggaatcc

SEQ ID NO: 2361 - DNA, 21 bp, Artificial Sequence
  source: /note="Description of Artificial Sequence: Synthetic oligonucleotide"
tgggcatctacccgggaatcc

SEQ ID NO: 2362 - DNA, 21 bp, Artificial Sequence
  source: /note="Description of Artificial Sequence: Synthetic oligonucleotide"
tggacttctacccgagattcc

SEQ ID NO: 2363 - DNA, 21 bp, Artificial Sequence
  source: /note="Description of Artificial Sequence: Synthetic oligonucleotide"
tggacttctacccgagattcc

SEQ ID NO: 2364 - DNA, 21 bp, Artificial Sequence
  source: /note="Description of Artificial Sequence: Synthetic oligonucleotide"
ggtgcatccagcagggccact

SEQ ID NO: 2365 - DNA, 21 bp, Artificial Sequence
  source: /note="Description of Artificial Sequence: Synthetic oligonucleotide"
ggtgcagccaccagggccact

SEQ ID NO: 2366 - DNA, 21 bp, Artificial Sequence
  source: /note="Description of Artificial Sequence: Synthetic oligonucleotide"
ggtgcatccagtttgcaaagt

SEQ ID NO: 2367 - DNA, 21 bp, Artificial Sequence
  source: /note="Description of Artificial Sequence: Synthetic oligonucleotide"
gatgcttccaatttggagcca

SEQ ID NO: 2368 - DNA, 21 bp, Artificial Sequence
  source: /note="Description of Artificial Sequence: Synthetic oligonucleotide"
gctgcatccagtttgcaaagt

SEQ ID NO: 2369 - DNA, 21 bp, Artificial Sequence
  source: /note="Description of Artificial Sequence: Synthetic oligonucleotide"
gctgcatccagtttgcaaagt

SEQ ID NO: 2370 - DNA, 21 bp, Artificial Sequence
  source: /note="Description of Artificial Sequence: Synthetic oligonucleotide"
ggtgcatccagtttgcaaagt

SEQ ID NO: 2371 - DNA, 21 bp, Artificial Sequence
  source: /note="Description of Artificial Sequence: Synthetic oligonucleotide"
ggtgcatccagtttgcaaagt

SEQ ID NO: 2372 - DNA, 21 bp, Artificial Sequence
  source: /note="Description of Artificial Sequence: Synthetic oligonucleotide"
ggtgcatccagtttgcaaagt

SEQ ID NO: 2373 - DNA, 21 bp, Artificial Sequence
  source: /note="Description of Artificial Sequence: Synthetic oligonucleotide"
ggtgcatccagtttgcaaagt

SEQ ID NO: 2374 - DNA, 21 bp, Artificial Sequence
  source: /note="Description of Artificial Sequence: Synthetic oligonucleotide"
ggtgcatccagtttgcaaagt

SEQ ID NO: 2375 - DNA, 21 bp, Artificial Sequence
  source: /note="Description of Artificial Sequence: Synthetic oligonucleotide"
ggtgcatccagtttgcaaagt

SEQ ID NO: 2376 - DNA, 21 bp, Artificial Sequence
  source: /note="Description of Artificial Sequence: Synthetic oligonucleotide"
ggtgcatccagtttgcaaagt

SEQ ID NO: 2377 - DNA, 21 bp, Artificial Sequence
  source: /note="Description of Artificial Sequence: Synthetic oligonucleotide"
ggtgcatccagtttgcaaagt

SEQ ID NO: 2378 - DNA, 21 bp, Artificial Sequence
  source: /note="Description of Artificial Sequence: Synthetic oligonucleotide"
ggtgcatccagtttgcaaagt

SEQ ID NO: 2379 - DNA, 21 bp, Artificial Sequence
  source: /note="Description of Artificial Sequence: Synthetic oligonucleotide"
ggtgcatccagtttgcaaagt

SEQ ID NO: 2380 - DNA, 21 bp, Artificial Sequence
  source: /note="Description of Artificial Sequence: Synthetic oligonucleotide"
ggtgcatccagtttgcaaagt

SEQ ID NO: 2381 - DNA, 21 bp, Artificial Sequence
  source: /note="Description of Artificial Sequence: Synthetic oligonucleotide"
ggtgcatccagtttgcaaagt

SEQ ID NO: 2382 - DNA, 21 bp, Artificial Sequence
  source: /note="Description of Artificial Sequence: Synthetic oligonucleotide"
ggtgcatccagtttgcaaagt

SEQ ID NO: 2383 - DNA, 21 bp, Artificial Sequence
  source: /note="Description of Artificial Sequence: Synthetic oligonucleotide"
ggtgcatccagtttgcaaagt

SEQ ID NO: 2384 - DNA, 21 bp, Artificial Sequence
  source: /note="Description of Artificial Sequence: Synthetic oligonucleotide"
ggtgcatccagtttgcaaagt

SEQ ID NO: 2385 - DNA, 21 bp, Artificial Sequence
  source: /note="Description of Artificial Sequence: Synthetic oligonucleotide"
ggtgcatccagtttgcaaagt

SEQ ID NO: 2386 - DNA, 21 bp, Artificial Sequence
  source: /note="Description of Artificial Sequence: Synthetic oligonucleotide"
ggtgcatccagtttgcaaagt

SEQ ID NO: 2387 - DNA, 21 bp, Artificial Sequence
  source: /note="Description of Artificial Sequence: Synthetic oligonucleotide"
ggtgcatccagtttgcaaagt

SEQ ID NO: 2388 - DNA, 21 bp, Artificial Sequence
  source: /note="Description of Artificial Sequence: Synthetic oligonucleotide"
ggtgcatccagtttgcaaagt

SEQ ID NO: 2389 - DNA, 21 bp, Artificial Sequence
  source: /note="Description of Artificial Sequence: Synthetic oligonucleotide"
ggtgcatccagtttgcaaagt

SEQ ID NO: 2390 - DNA, 21 bp, Artificial Sequence
  source: /note="Description of Artificial Sequence: Synthetic oligonucleotide"
ggtgcatccagtttgcaaagt

SEQ ID NO: 2391 - DNA, 21 bp, Artificial Sequence
  source: /note="Description of Artificial Sequence: Synthetic oligonucleotide"
ggtgcatccagtttgcaaagt

SEQ ID NO: 2392 - DNA, 21 bp, Artificial Sequence
  source: /note="Description of Artificial Sequence: Synthetic oligonucleotide"
ggtgcatccagtttgcaaagt

SEQ ID NO: 2393 - DNA, 21 bp, Artificial Sequence
  source: /note="Description of Artificial Sequence: Synthetic oligonucleotide"
ggtgcatccagtttgcaaagt

SEQ ID NO: 2394 - DNA, 21 bp, Artificial Sequence
  source: /note="Description of Artificial Sequence: Synthetic oligonucleotide"
ggtgcatccagtttgcaaagt

SEQ ID NO: 2395 - DNA, 21 bp, Artificial Sequence
  source: /note="Description of Artificial Sequence: Synthetic oligonucleotide"
gatgcatccaatttggaaaca

SEQ ID NO: 2396 - DNA, 21 bp, Artificial Sequence
  source: /note="Description of Artificial Sequence: Synthetic oligonucleotide"
gatgcatccaatttggaaaca

SEQ ID NO: 2397 - DNA, 21 bp, Artificial Sequence
  source: /note="Description of Artificial Sequence: Synthetic oligonucleotide"
gatgcatccaatttggaaaca

SEQ ID NO: 2398 - DNA, 21 bp, Artificial Sequence
  source: /note="Description of Artificial Sequence: Synthetic oligonucleotide"
gatgcatccaatttggaaaca

SEQ ID NO: 2399 - DNA, 21 bp, Artificial Sequence
  source: /note="Description of Artificial Sequence: Synthetic oligonucleotide"
gatgcatccaatttggaaaca

SEQ ID NO: 2400 - DNA, 21 bp, Artificial Sequence
  source: /note="Description of Artificial Sequence: Synthetic oligonucleotide"
gatgcatccaatttggaaaca

SEQ ID NO: 2401 - DNA, 21 bp, Artificial Sequence
  source: /note="Description of Artificial Sequence: Synthetic oligonucleotide"
gatgcatccaatttggaaaca

SEQ ID NO: 2402 - DNA, 21 bp, Artificial Sequence
  source: /note="Description of Artificial Sequence: Synthetic oligonucleotide"
gatgcatccaatttggaaaca

SEQ ID NO: 2403 - DNA, 21 bp, Artificial Sequence
  source: /note="Description of Artificial Sequence: Synthetic oligonucleotide"
gatgcatccaatttggaaaca

SEQ ID NO: 2404 - DNA, 21 bp, Artificial Sequence
  source: /note="Description of Artificial Sequence: Synthetic oligonucleotide"
ggtgcatccagtttgcaaagt

SEQ ID NO: 2405 - DNA, 21 bp, Artificial Sequence
  source: /note="Description of Artificial Sequence: Synthetic oligonucleotide"
ggtgcatccagtttgcaaagt

SEQ ID NO: 2406 - DNA, 21 bp, Artificial Sequence
  source: /note="Description of Artificial Sequence: Synthetic oligonucleotide"
ggtgcatccagtttgcaaagt

SEQ ID NO: 2407 - DNA, 21 bp, Artificial Sequence
  source: /note="Description of Artificial Sequence: Synthetic oligonucleotide"
ggtgcatccagtttgcaaagt

SEQ ID NO: 2408 - DNA, 21 bp, Artificial Sequence
  source: /note="Description of Artificial Sequence: Synthetic oligonucleotide"
ggtgcatccagtttgcaaagt

SEQ ID NO: 2409 - DNA, 21 bp, Artificial Sequence
  source: /note="Description of Artificial Sequence: Synthetic oligonucleotide"
ggtgcatccagtttgcaaagt

SEQ ID NO: 2410 - DNA, 21 bp, Artificial Sequence
  source: /note="Description of Artificial Sequence: Synthetic oligonucleotide"
ggtgcatccagtttgcaaagt

SEQ ID NO: 2411 - DNA, 21 bp, Artificial Sequence
  source: /note="Description of Artificial Sequence: Synthetic oligonucleotide"
gatgcttccaatttggagcca

SEQ ID NO: 2412 - DNA, 21 bp, Artificial Sequence
  source: /note="Description of Artificial Sequence: Synthetic oligonucleotide"
gatgcttccaatttggagcca

SEQ ID NO: 2413 - DNA, 21 bp, Artificial Sequence
  source: /note="Description of Artificial Sequence: Synthetic oligonucleotide"
gatgcttccaatttggagcca

SEQ ID NO: 2414 - DNA, 21 bp, Artificial Sequence
  source: /note="Description of Artificial Sequence: Synthetic oligonucleotide"
gatgcttccaatttggagcca

SEQ ID NO: 2415 - DNA, 21 bp, Artificial Sequence
  source: /note="Description of Artificial Sequence: Synthetic oligonucleotide"
gatgcttccaatttggagcca

SEQ ID NO: 2416 - DNA, 21 bp, Artificial Sequence
  source: /note="Description of Artificial Sequence: Synthetic oligonucleotide"
gatgcttccaatttggagcca

SEQ ID NO: 2417 - DNA, 21 bp, Artificial Sequence
  source: /note="Description of Artificial Sequence: Synthetic oligonucleotide"
gatgcttccaatttggagcca

SEQ ID NO: 2418 - DNA, 21 bp, Artificial Sequence
  source: /note="Description of Artificial Sequence: Synthetic oligonucleotide"
gatgcttccaatttggagcca

SEQ ID NO: 2419 - DNA, 21 bp, Artificial Sequence
  source: /note="Description of Artificial Sequence: Synthetic oligonucleotide"
gatgcttccaatttggagcca

SEQ ID NO: 2420 - DNA, 21 bp, Artificial Sequence
  source: /note="Description of Artificial Sequence: Synthetic oligonucleotide"
gatgcttccaatttggagcca

SEQ ID NO: 2421 - DNA, 21 bp, Artificial Sequence
  source: /note="Description of Artificial Sequence: Synthetic oligonucleotide"
gatgcttccaatttggagcca

SEQ ID NO: 2422 - DNA, 21 bp, Artificial Sequence
  source: /note="Description of Artificial Sequence: Synthetic oligonucleotide"
ggtgcatccagcagggccact

SEQ ID NO: 2423 - DNA, 21 bp, Artificial Sequence
  source: /note="Description of Artificial Sequence: Synthetic oligonucleotide"
ggtgcatccagcagggccact

SEQ ID NO: 2424 - DNA, 21 bp, Artificial Sequence
  source: /note="Description of Artificial Sequence: Synthetic oligonucleotide"
ggtgcatccagcagggccact

SEQ ID NO: 2425 - DNA, 21 bp, Artificial Sequence
  source: /note="Description of Artificial Sequence: Synthetic oligonucleotide"
ggtgcatccagcagggccact

SEQ ID NO: 2426 - DNA, 21 bp, Artificial Sequence
  source: /note="Description of Artificial Sequence: Synthetic oligonucleotide"
ggtgcagccaccagggccact

SEQ ID NO: 2427 - DNA, 21 bp, Artificial Sequence
  source: /note="Description of Artificial Sequence: Synthetic oligonucleotide"
ggtgcagccaccagggccact

SEQ ID NO: 2428 - DNA, 21 bp, Artificial Sequence
  source: /note="Description of Artificial Sequence: Synthetic oligonucleotide"
ggtgcagccaccagggccact

SEQ ID NO: 2429 - DNA, 21 bp, Artificial Sequence
  source: /note="Description of Artificial Sequence: Synthetic oligonucleotide"
ggtgcagccaccagggccact

SEQ ID NO: 2430 - DNA, 21 bp, Artificial Sequence
  source: /note="Description of Artificial Sequence: Synthetic oligonucleotide"
ggtgcagccaccagggccact

SEQ ID NO: 2431 - DNA, 21 bp, Artificial Sequence
  source: /note="Description of Artificial Sequence: Synthetic oligonucleotide"
ggtgcagccaccagggccact

SEQ ID NO: 2432 - DNA, 21 bp, Artificial Sequence
  source: /note="Description of Artificial Sequence: Synthetic oligonucleotide"
ggtgcagccaccagggccact

SEQ ID NO: 2433 - DNA, 21 bp, Artificial Sequence
  source: /note="Description of Artificial Sequence: Synthetic oligonucleotide"
ggtgcagccaccagggccact

SEQ ID NO: 2434 - DNA, 21 bp, Artificial Sequence
  source: /note="Description of Artificial Sequence: Synthetic oligonucleotide"
ggtgcatccagcagggccact

SEQ ID NO: 2435 - DNA, 21 bp, Artificial Sequence
  source: /note="Description of Artificial Sequence: Synthetic oligonucleotide"
ggtgcatccagcagggccact

SEQ ID NO: 2436 - DNA, 21 bp, Artificial Sequence
  source: /note="Description of Artificial Sequence: Synthetic oligonucleotide"
ggtgcatccagcagggccact

SEQ ID NO: 2437 - DNA, 21 bp, Artificial Sequence
  source: /note="Description of Artificial Sequence: Synthetic oligonucleotide"
ggtgcatccagcagggccact

SEQ ID NO: 2438 - DNA, 21 bp, Artificial Sequence
  source: /note="Description of Artificial Sequence: Synthetic oligonucleotide"
ggtgcatccagcagggccact

SEQ ID NO: 2439 - DNA, 21 bp, Artificial Sequence
  source: /note="Description of Artificial Sequence: Synthetic oligonucleotide"
ggtgcatccagcagggccact

SEQ ID NO: 2440 - DNA, 21 bp, Artificial Sequence
  source: /note="Description of Artificial Sequence: Synthetic oligonucleotide"
ggtgcatccagcagggccact

SEQ ID NO: 2441 - DNA, 21 bp, Artificial Sequence
  source: /note="Description of Artificial Sequence: Synthetic oligonucleotide"
tgggcatctacccgggaatcc

SEQ ID NO: 2442 - DNA, 21 bp, Artificial Sequence
  source: /note="Description of Artificial Sequence: Synthetic oligonucleotide"
tgggcatctacccgggaatcc

SEQ ID NO: 2443 - DNA, 21 bp, Artificial Sequence
  source: /note="Description of Artificial Sequence: Synthetic oligonucleotide"
tgggcatctacccgggaatcc

SEQ ID NO: 2444 - DNA, 21 bp, Artificial Sequence
  source: /note="Description of Artificial Sequence: Synthetic oligonucleotide"
tgggcatctacccgggaatcc

SEQ ID NO: 2445 - DNA, 21 bp, Artificial Sequence
  source: /note="Description of Artificial Sequence: Synthetic oligonucleotide"
tgggcatctacccgggaatcc

SEQ ID NO: 2446 - DNA, 21 bp, Artificial Sequence
  source: /note="Description of Artificial Sequence: Synthetic oligonucleotide"
tgggcatctacccgggaatcc

SEQ ID NO: 2447 - DNA, 21 bp, Artificial Sequence
  source: /note="Description of Artificial Sequence: Synthetic oligonucleotide"
tgggcatctacccgggaatcc

SEQ ID NO: 2448 - DNA, 21 bp, Artificial Sequence
  source: /note="Description of Artificial Sequence: Synthetic oligonucleotide"
tgggcatctacccgggaatcc

SEQ ID NO: 2449 - DNA, 21 bp, Artificial Sequence
  source: /note="Description of Artificial Sequence: Synthetic oligonucleotide"
tgggcatctacccgggaatcc

SEQ ID NO: 2450 - DNA, 21 bp, Artificial Sequence
  source: /note="Description of Artificial Sequence: Synthetic oligonucleotide"
tgggcatctacccgggaatcc

SEQ ID NO: 2451 - DNA, 21 bp, Artificial Sequence
  source: /note="Description of Artificial Sequence: Synthetic oligonucleotide"
tgggcatctacccgggaatcc

SEQ ID NO: 2452 - DNA, 21 bp, Artificial Sequence
  source: /note="Description of Artificial Sequence: Synthetic oligonucleotide"
tggacttctacccgagaatcc

SEQ ID NO: 2453 - DNA, 21 bp, Artificial Sequence
  source: /note="Description of Artificial Sequence: Synthetic oligonucleotide"
tggacttctacccgagaatcc

SEQ ID NO: 2454 - DNA, 21 bp, Artificial Sequence
  source: /note="Description of Artificial Sequence: Synthetic oligonucleotide"
tggacttctacccgagattcc

SEQ ID NO: 2455 - DNA, 21 bp, Artificial Sequence
  source: /note="Description of Artificial Sequence: Synthetic oligonucleotide"
tggacttctacccgagaatcc

SEQ ID NO: 2456 - DNA, 21 bp, Artificial Sequence
  source: /note="Description of Artificial Sequence: Synthetic oligonucleotide"
tggacttctacccgagaatcc

SEQ ID NO: 2457 - DNA, 21 bp, Artificial Sequence
  source: /note="Description of Artificial Sequence: Synthetic oligonucleotide"
tggacttctacccgagattcc

SEQ ID NO: 2458 - DNA, 21 bp, Artificial Sequence
  source: /note="Description of Artificial Sequence: Synthetic oligonucleotide"
tggacttctacccgagattcc

SEQ ID NO: 2459 - DNA, 21 bp, Artificial Sequence
  source: /note="Description of Artificial Sequence: Synthetic oligonucleotide"
tggacttctacccgagaatcc

SEQ ID NO: 2460 - DNA, 21 bp, Artificial Sequence
  source: /note="Description of Artificial Sequence: Synthetic oligonucleotide"
tggacttctacccgagaatcc

SEQ ID NO: 2461 - DNA, 21 bp, Artificial Sequence
  source: /note="Description of Artificial Sequence: Synthetic oligonucleotide"
tgggcatctacccgggaatcc

SEQ ID NO: 2462 - DNA, 21 bp, Artificial Sequence
  source: /note="Description of Artificial Sequence: Synthetic oligonucleotide"
tgggcatctacccgggaatcc

SEQ ID NO: 2463 - DNA, 21 bp, Artificial Sequence
  source: /note="Description of Artificial Sequence: Synthetic oligonucleotide"
tgggcatctacccgggaatcc

SEQ ID NO: 2464 - DNA, 21 bp, Artificial Sequence
  source: /note="Description of Artificial Sequence: Synthetic oligonucleotide"
tgggcatctacccgggaatcc

SEQ ID NO: 2465 - DNA, 21 bp, Artificial Sequence
  source: /note="Description of Artificial Sequence: Synthetic oligonucleotide"
tgggcatctacccgggaatcc

SEQ ID NO: 2466 - DNA, 21 bp, Artificial Sequence
  source: /note="Description of Artificial Sequence: Synthetic oligonucleotide"
tggacttctacccgagattcc

SEQ ID NO: 2467 - DNA, 21 bp, Artificial Sequence
  source: /note="Description of Artificial Sequence: Synthetic oligonucleotide"
tggacttctacccgagattcc

SEQ ID NO: 2468 - DNA, 21 bp, Artificial Sequence
  source: /note="Description of Artificial Sequence: Synthetic oligonucleotide"
tggacttctacccgagattcc

SEQ ID NO: 2469 - DNA, 21 bp, Artificial Sequence
  source: /note="Description of Artificial Sequence: Synthetic oligonucleotide"
tggacttctacccgagattcc

SEQ ID NO: 2470 - DNA, 21 bp, Artificial Sequence
  source: /note="Description of Artificial Sequence: Synthetic oligonucleotide"
tggacttctacccgagattcc

SEQ ID NO: 2471 - DNA, 21 bp, Artificial Sequence
  source: /note="Description of Artificial Sequence: Synthetic oligonucleotide"
tggacttctacccgagattcc

SEQ ID NO: 2472 - DNA, 21 bp, Artificial Sequence
  source: /note="Description of Artificial Sequence: Synthetic oligonucleotide"
tggacttctacccgagattcc

SEQ ID NO: 2473 - DNA, 21 bp, Artificial Sequence
  source: /note="Description of Artificial Sequence: Synthetic oligonucleotide"
tggacttctacccgagaatcc

SEQ ID NO: 2474 - DNA, 21 bp, Artificial Sequence
  source: /note="Description of Artificial Sequence: Synthetic oligonucleotide"
tggacttctacccgagaatcc

SEQ ID NO: 2475 - DNA, 21 bp, Artificial Sequence
  source: /note="Description of Artificial Sequence: Synthetic oligonucleotide"
tggacttctacccgagaatcc

SEQ ID NO: 2476 - DNA, 21 bp, Artificial Sequence
  source: /note="Description of Artificial Sequence: Synthetic oligonucleotide"
tggacttctacccgagaatcc

SEQ ID NO: 2477 - DNA, 21 bp, Artificial Sequence
  source: /note="Description of Artificial Sequence: Synthetic oligonucleotide"
tggacttctacccgagattcc

SEQ ID NO: 2478 - DNA, 21 bp, Artificial Sequence
  source: /note="Description of Artificial Sequence: Synthetic oligonucleotide"
tggacttctacccgagaatcc

SEQ ID NO: 2479 - DNA, 21 bp, Artificial Sequence
  source: /note="Description of Artificial Sequence: Synthetic oligonucleotide"
actaataatcagcggccctca

SEQ ID NO: 2480 - DNA, 21 bp, Artificial Sequence
  source: /note="Description of Artificial Sequence: Synthetic oligonucleotide"
actaataatcagcggccctca

SEQ ID NO: 2481 - DNA, 21 bp, Artificial Sequence
  source: /note="Description of Artificial Sequence: Synthetic oligonucleotide"
actaataatcagcggccctca

SEQ ID NO: 2482 - DNA, 21 bp, Artificial Sequence
  source: /note="Description of Artificial Sequence: Synthetic oligonucleotide"
actaataatcagcggccctca

SEQ ID NO: 2483 - DNA, 21 bp, Artificial Sequence
  source: /note="Description of Artificial Sequence: Synthetic oligonucleotide"
actaataatcagcggccctca

SEQ ID NO: 2484 - DNA, 21 bp, Artificial Sequence
  source: /note="Description of Artificial Sequence: Synthetic oligonucleotide"
actaataatcagcggccctca

SEQ ID NO: 2485 - DNA, 21 bp, Artificial Sequence
  source: /note="Description of Artificial Sequence: Synthetic oligonucleotide"
actaataatcagcggccctca

SEQ ID NO: 2486 - DNA, 21 bp, Artificial Sequence
  source: /note="Description of Artificial Sequence: Synthetic oligonucleotide"
actaataatcagcggccctca

SEQ ID NO: 2487 - DNA, 21 bp, Artificial Sequence
  source: /note="Description of Artificial Sequence: Synthetic oligonucleotide"
actaataatcagcggccctca

SEQ ID NO: 2488 - DNA, 21 bp, Artificial Sequence
  source: /note="Description of Artificial Sequence: Synthetic oligonucleotide"
actaataatcagcggccctca

SEQ ID NO: 2489 - DNA, 21 bp, Artificial Sequence
  source: /note="Description of Artificial Sequence: Synthetic oligonucleotide"
actaataatcagcggccctca

SEQ ID NO: 2490 - DNA, 21 bp, Artificial Sequence
  source: /note="Description of Artificial Sequence: Synthetic oligonucleotide"
actaataatcagcggccctca

SEQ ID NO: 2491 - DNA, 21 bp, Artificial Sequence
  source: /note="Description of Artificial Sequence: Synthetic oligonucleotide"
actaataatcagcggccctca

SEQ ID NO: 2492 - DNA, 21 bp, Artificial Sequence
  source: /note="Description of Artificial Sequence: Synthetic oligonucleotide"
actaataatcagcggccctca

SEQ ID NO: 2493 - DNA, 21 bp, Artificial Sequence
  source: /note="Description of Artificial Sequence: Synthetic oligonucleotide"
ggtgcatccagtttgcaaagt

SEQ ID NO: 2494 - DNA, 21 bp, Artificial Sequence
  source: /note="Description of Artificial Sequence: Synthetic oligonucleotide"
ggtgcatccagtttgcaaagt

SEQ ID NO: 2495 - DNA, 21 bp, Artificial Sequence
  source: /note="Description of Artificial Sequence: Synthetic oligonucleotide"
actaataatcagcggccctca

SEQ ID NO: 2496 - DNA, 21 bp, Artificial Sequence
  source: /note="Description of Artificial Sequence: Synthetic oligonucleotide"
gttgcatccagtttgcaaagt

SEQ ID NO: 2497 - DNA, 21 bp, Artificial Sequence
  source: /note="Description of Artificial Sequence: Synthetic oligonucleotide"
gacaataataagcgaccctca

SEQ ID NO: 2498 - DNA, 21 bp, Artificial Sequence
  source: /note="Description of Artificial Sequence: Synthetic oligonucleotide"
gttgcatccagtttgcaaagt

SEQ ID NO: 2499 - DNA, 21 bp, Artificial Sequence
  source: /note="Description of Artificial Sequence: Synthetic oligonucleotide"
gttgcatccagtttgcaaagt

SEQ ID NO: 2500 - DNA, 21 bp, Artificial Sequence
  source: /note="Description of Artificial Sequence: Synthetic oligonucleotide"
gttgcatccagtttgcaaagt

SEQ ID NO: 2501 - DNA, 21 bp, Artificial Sequence
  source: /note="Description of Artificial Sequence: Synthetic oligonucleotide"
gttgcatccagtttgcaaagt

SEQ ID NO: 2502 - DNA, 21 bp, Artificial Sequence
  source: /note="Description of Artificial Sequence: Synthetic oligonucleotide"
gttgcatccagtttgcaaagt

SEQ ID NO: 2503 - DNA, 21 bp, Artificial Sequence
  source: /note="Description of Artificial Sequence: Synthetic oligonucleotide"
gttgcatccagtttgcaaagt

SEQ ID NO: 2504 - DNA, 21 bp, Artificial Sequence
  source: /note="Description of Artificial Sequence: Synthetic oligonucleotide"
gacaataataagcgaccctca

SEQ ID NO: 2505 - DNA, 21 bp, Artificial Sequence
  source: /note="Description of Artificial Sequence: Synthetic oligonucleotide"
gacaataataagcgaccctca

SEQ ID NO: 2506 - DNA, 21 bp, Artificial Sequence
  source: /note="Description of Artificial Sequence: Synthetic oligonucleotide"
gacaataataagcgaccctca

SEQ ID NO: 2507 - DNA, 21 bp, Artificial Sequence
  source: /note="Description of Artificial Sequence: Synthetic oligonucleotide"
gacaataataagcgaccctca

SEQ ID NO: 2508 - DNA, 21 bp, Artificial Sequence
  source: /note="Description of Artificial Sequence: Synthetic oligonucleotide"
gacaataataagcgaccctca

SEQ ID NO: 2509 - DNA, 21 bp, Artificial Sequence
  source: /note="Description of Artificial Sequence: Synthetic oligonucleotide"
gacaataataagcgaccctca

SEQ ID NO: 2510 - DNA, 21 bp, Artificial Sequence
  source: /note="Description of Artificial Sequence: Synthetic oligonucleotide"
gacaataataagcgaccctca

SEQ ID NO: 2511 - DNA, 21 bp, Artificial Sequence
  source: /note="Description of Artificial Sequence: Synthetic oligonucleotide"
gacaataataagcgaccctca

SEQ ID NO: 2512 - DNA, 21 bp, Artificial Sequence
  source: /note="Description of Artificial Sequence: Synthetic oligonucleotide"
gttgcatccagtttgcaaagt

SEQ ID NO: 2513 - DNA, 33 bp, Artificial Sequence
  source: /note="Description of Artificial Sequence: Synthetic oligonucleotide"
gcaacattcgatgacagcctgaatggtccggta

SEQ ID NO: 2514 - DNA, 27 bp, Artificial Sequence
  source: /note="Description of Artificial Sequence: Synthetic oligonucleotide"
ctacagcataataattaccccttcact

SEQ ID NO: 2515 - DNA, 27 bp, Artificial Sequence
  source: /note="Description of Artificial Sequence: Synthetic oligonucleotide"
ctacagcataataattaccccttcact

SEQ ID NO: 2516 - DNA, 24 bp, Artificial Sequence
  source: /note="Description of Artificial Sequence: Synthetic oligonucleotide"
caacagtatgatattctcctcact

SEQ ID NO: 2517 - DNA, 27 bp, Artificial Sequence
  source: /note="Description of Artificial Sequence: Synthetic oligonucleotide"
caacaatattatagtactccgtggacg

SEQ ID NO: 2518 - DNA, 27 bp, Artificial Sequence
  source: /note="Description of Artificial Sequence: Synthetic oligonucleotide"
caacaatattatagtactccgtggacg

SEQ ID NO: 2519 - DNA, 27 bp, Artificial Sequence
  source: /note="Description of Artificial Sequence: Synthetic oligonucleotide"
cagcaatattatcgtactccgtggacg

SEQ ID NO: 2520 - DNA, 27 bp, Artificial Sequence
  source: /note="Description of Artificial Sequence: Synthetic oligonucleotide"
cagcaatattatcgtactccgtggacg

SEQ ID NO: 2521 - DNA, 27 bp, Artificial Sequence
  source: /note="Description of Artificial Sequence: Synthetic oligonucleotide"
cagcagtatggtagttcaccgctcact

SEQ ID NO: 2522 - DNA, 27 bp, Artificial Sequence
  source: /note="Description of Artificial Sequence: Synthetic oligonucleotide"
cagcagtataataactggcctctcact

SEQ ID NO: 2523 - DNA, 27 bp, Artificial Sequence
  source: /note="Description of Artificial Sequence: Synthetic oligonucleotide"
ctacagcataatagttacccattcact

SEQ ID NO: 2524 - DNA, 24 bp, Artificial Sequence
  source: /note="Description of Artificial Sequence: Synthetic oligonucleotide"
caacagtatgatgatctattcact

SEQ ID NO: 2525 - DNA, 27 bp, Artificial Sequence
  source: /note="Description of Artificial Sequence: Synthetic oligonucleotide"
caacagactaacagtttccctccgacg

SEQ ID NO: 2526 - DNA, 27 bp, Artificial Sequence
  source: /note="Description of Artificial Sequence: Synthetic oligonucleotide"
caacagactaacagtttccctccgacg

SEQ ID NO: 2527 - DNA, 27 bp, Artificial Sequence
  source: /note="Description of Artificial Sequence: Synthetic oligonucleotide"
ctacagcataatagttacccattcact

SEQ ID NO: 2528 - DNA, 27 bp, Artificial Sequence
  source: /note="Description of Artificial Sequence: Synthetic oligonucleotide"
ctacagcataatagttacccattcact

SEQ ID NO: 2529 - DNA, 27 bp, Artificial Sequence
  source: /note="Description of Artificial Sequence: Synthetic oligonucleotide"
ctacagcataatagttacccattcact

SEQ ID NO: 2530 - DNA, 27 bp, Artificial Sequence
  source: /note="Description of Artificial Sequence: Synthetic oligonucleotide"
ctacagcataatagttacccattcact

SEQ ID NO: 2531 - DNA, 27 bp, Artificial Sequence
  source: /note="Description of Artificial Sequence: Synthetic oligonucleotide"
ctacagcataatagttacccattcact

SEQ ID NO: 2532 - DNA, 27 bp, Artificial Sequence
  source: /note="Description of Artificial Sequence: Synthetic oligonucleotide"
ctacagcataatagttacccattcact

SEQ ID NO: 2533 - DNA, 27 bp, Artificial Sequence
  source: /note="Description of Artificial Sequence: Synthetic oligonucleotide"
ctacagcataataattaccccttcact

SEQ ID NO: 2534 - DNA, 27 bp, Artificial Sequence
  source: /note="Description of Artificial Sequence: Synthetic oligonucleotide"
ctacagcataataattaccccttcact

SEQ ID NO: 2535 - DNA, 27 bp, Artificial Sequence
  source: /note="Description of Artificial Sequence: Synthetic oligonucleotide"
ctacagcataataattaccccttcact

SEQ ID NO: 2536 - DNA, 27 bp, Artificial Sequence
  source: /note="Description of Artificial Sequence: Synthetic oligonucleotide"
ctacagcataataattaccccttcact

SEQ ID NO: 2537 - DNA, 27 bp, Artificial Sequence
  source: /note="Description of Artificial Sequence: Synthetic oligonucleotide"
ctacagcataataattaccccttcact

SEQ ID NO: 2538 - DNA, 27 bp, Artificial Sequence
  source: /note="Description of Artificial Sequence: Synthetic oligonucleotide"
ctacagcataataattaccccttcact

SEQ ID NO: 2539 - DNA, 27 bp, Artificial Sequence
  source: /note="Description of Artificial Sequence: Synthetic oligonucleotide"
ctacagcataataattaccccttcact

SEQ ID NO: 2540 - DNA, 27 bp, Artificial Sequence
  source: /note="Description of Artificial Sequence: Synthetic oligonucleotide"
ctacagcataataattaccccttcact

SEQ ID NO: 2541 - DNA, 27 bp, Artificial Sequence
  source: /note="Description of Artificial Sequence: Synthetic oligonucleotide"
ctacagcataataattaccccttcact

SEQ ID NO: 2542 - DNA, 27 bp, Artificial Sequence
  source: /note="Description of Artificial Sequence: Synthetic oligonucleotide"
ctacagcataataattaccccttcact

SEQ ID NO: 2543 - DNA, 27 bp, Artificial Sequence
  source: /note="Description of Artificial Sequence: Synthetic oligonucleotide"
ctacagcataataattaccccttcact

SEQ ID NO: 2544 - DNA, 27 bp, Artificial Sequence
  source: /note="Description of Artificial Sequence: Synthetic oligonucleotide"
ctacagcataataattaccccttcact

SEQ ID NO: 2545 - DNA, 27 bp, Artificial Sequence
  source: /note="Description of Artificial Sequence: Synthetic oligonucleotide"
ctacagcataataattaccccttcact

SEQ ID NO: 2546 - DNA, 27 bp, Artificial Sequence
  source: /note="Description of Artificial Sequence: Synthetic oligonucleotide"
ctacagcataataattaccccttcact

SEQ ID NO: 2547 - DNA, 27 bp, Artificial Sequence
  source: /note="Description of Artificial Sequence: Synthetic oligonucleotide"
ctacagcataataattaccccttcact

SEQ ID NO: 2548 - DNA, 27 bp, Artificial Sequence
  source: /note="Description of Artificial Sequence: Synthetic oligonucleotide"
ctacagcataataattaccccttcact

SEQ ID NO: 2549 - DNA, 27 bp, Artificial Sequence
  source: /note="Description of Artificial Sequence: Synthetic oligonucleotide"
ctacagcataataattaccccttcact

SEQ ID NO: 2550 - DNA, 27 bp, Artificial Sequence
  source: /note="Description of Artificial Sequence: Synthetic oligonucleotide"
ctacagcataataattaccccttcact

SEQ ID NO: 2551 - DNA, 27 bp, Artificial Sequence
  source: /note="Description of Artificial Sequence: Synthetic oligonucleotide"
ctacagcataataattaccccttcact

SEQ ID NO: 2552 - DNA, 24 bp, Artificial Sequence
  source: /note="Description of Artificial Sequence: Synthetic oligonucleotide"
caacagtatgatattctcctcact

SEQ ID NO: 2553 - DNA, 24 bp, Artificial Sequence
  source: /note="Description of Artificial Sequence: Synthetic oligonucleotide"
caacagtatgatattctcctcact

SEQ ID NO: 2554 - DNA, 24 bp, Artificial Sequence
  source: /note="Description of Artificial Sequence: Synthetic oligonucleotide"
caacagtatgatattctcctcact

SEQ ID NO: 2555 - DNA, 24 bp, Artificial Sequence
  source: /note="Description of Artificial Sequence: Synthetic oligonucleotide"
caacagtatgatattctcctcact

SEQ ID NO: 2556 - DNA, 24 bp, Artificial Sequence
  source: /note="Description of Artificial Sequence: Synthetic oligonucleotide"
caacagtatgatattctcctcact

SEQ ID NO: 2557 - DNA, 24 bp, Artificial Sequence
  source: /note="Description of Artificial Sequence: Synthetic oligonucleotide"
caacagtatgatattctcctcact

SEQ ID NO: 2558 - DNA, 24 bp, Artificial Sequence
  source: /note="Description of Artificial Sequence: Synthetic oligonucleotide"
caacagtatgatattctcctcact

SEQ ID NO: 2559 - DNA, 24 bp, Artificial Sequence
  source: /note="Description of Artificial Sequence: Synthetic oligonucleotide"
caacagtatgatattctcctcact

SEQ ID NO: 2560 - DNA, 24 bp, Artificial Sequence
  source: /note="Description of Artificial Sequence: Synthetic oligonucleotide"
caacagtatgatattctcctcact

SEQ ID NO: 2561 - DNA, 27 bp, Artificial Sequence
  source: /note="Description of Artificial Sequence: Synthetic oligonucleotide"
ctacagcataataattaccccttcact

SEQ ID NO: 2562 - DNA, 27 bp, Artificial Sequence
  source: /note="Description of Artificial Sequence: Synthetic oligonucleotide"
ctacagcataataattaccccttcact

SEQ ID NO: 2563 - DNA, 27 bp, Artificial Sequence
  source: /note="Description of Artificial Sequence: Synthetic oligonucleotide"
ctacagcataataattaccccttcact

SEQ ID NO: 2564 - DNA, 27 bp, Artificial Sequence
  source: /note="Description of Artificial Sequence: Synthetic oligonucleotide"
ctacagcataataattaccccttcact

SEQ ID NO: 2565 - DNA, 27 bp, Artificial Sequence
  source: /note="Description of Artificial Sequence: Synthetic oligonucleotide"
ctacagcataataattaccccttcact

SEQ ID NO: 2566 - DNA, 27 bp, Artificial Sequence
  source: /note="Description of Artificial Sequence: Synthetic oligonucleotide"
ctacagcataataattaccccttcact

SEQ ID NO: 2567 - DNA, 27 bp, Artificial Sequence
  source: /note="Description of Artificial Sequence: Synthetic oligonucleotide"
ctacagcataataattaccccttcact

SEQ ID NO: 2568 - DNA, 24 bp, Artificial Sequence
  source: /note="Description of Artificial Sequence: Synthetic oligonucleotide"
caacagtatgatgatctattcact

SEQ ID NO: 2569 - DNA, 24 bp, Artificial Sequence
  source: /note="Description of Artificial Sequence: Synthetic oligonucleotide"
caacagtatgatgatctattcact

SEQ ID NO: 2570 - DNA, 24 bp, Artificial Sequence
  source: /note="Description of Artificial Sequence: Synthetic oligonucleotide"
caacagtatgatgatctattcact

SEQ ID NO: 2571 - DNA, 24 bp, Artificial Sequence
  source: /note="Description of Artificial Sequence: Synthetic oligonucleotide"
caacagtatgatgatctattcact

SEQ ID NO: 2572 - DNA, 24 bp, Artificial Sequence
  source: /note="Description of Artificial Sequence: Synthetic oligonucleotide"
caacagtatgatgatctattcact

SEQ ID NO: 2573 - DNA, 24 bp, Artificial Sequence
  source: /note="Description of Artificial Sequence: Synthetic oligonucleotide"
caacagtatgatgatctattcact

SEQ ID NO: 2574 - DNA, 24 bp, Artificial Sequence
  source: /note="Description of Artificial Sequence: Synthetic oligonucleotide"
caacagtatgatgatctattcact

SEQ ID NO: 2575 - DNA, 24 bp, Artificial Sequence
  source: /note="Description of Artificial Sequence: Synthetic oligonucleotide"
caacagtatgatgatctattcact

SEQ ID NO: 2576 - DNA, 24 bp, Artificial Sequence
  source: /note="Description of Artificial Sequence: Synthetic oligonucleotide"
caacagtatgatgatctattcact

SEQ ID NO: 2577 - DNA, 24 bp, Artificial Sequence
  source: /note="Description of Artificial Sequence: Synthetic oligonucleotide"
caacagtatgatgatctattcact

SEQ ID NO: 2578 - DNA, 24 bp, Artificial Sequence
  source: /note="Description of Artificial Sequence: Synthetic oligonucleotide"
caacagtatgatgatctattcact

SEQ ID NO: 2579 - DNA, 24 bp, Artificial Sequence
  source: /note="Description of Artificial Sequence: Synthetic oligonucleotide"
cagcagtatggtagctcacctcgc

SEQ ID NO: 2580 - DNA, 24 bp, Artificial Sequence
  source: /note="Description of Artificial Sequence: Synthetic oligonucleotide"
cagcagtatggtagctcacctcgc

SEQ ID NO: 2581 - DNA, 24 bp, Artificial Sequence
  source: /note="Description of Artificial Sequence: Synthetic oligonucleotide"
cagcagtatggtagctcacctcgc

SEQ ID NO: 2582 - DNA, 24 bp, Artificial Sequence
  source: /note="Description of Artificial Sequence: Synthetic oligonucleotide"
cagcagtatggtagctcacctcgc

SEQ ID NO: 2583 - DNA, 27 bp, Artificial Sequence
  source: /note="Description of Artificial Sequence: Synthetic oligonucleotide"
cagcagtataataactggcctctcact

SEQ ID NO: 2584 - DNA, 27 bp, Artificial Sequence
  source: /note="Description of Artificial Sequence: Synthetic oligonucleotide"
cagcagtataataactggcctctcact

SEQ ID NO: 2585 - DNA, 27 bp, Artificial Sequence
  source: /note="Description of Artificial Sequence: Synthetic oligonucleotide"
cagcagtataataactggcctctcact

SEQ ID NO: 2586 - DNA, 27 bp, Artificial Sequence
  source: /note="Description of Artificial Sequence: Synthetic oligonucleotide"
cagcagtataataactggcctctcact

SEQ ID NO: 2587 - DNA, 27 bp, Artificial Sequence
  source: /note="Description of Artificial Sequence: Synthetic oligonucleotide"
cagcagtataataacttccctctcact

SEQ ID NO: 2588 - DNA, 27 bp, Artificial Sequence
  source: /note="Description of Artificial Sequence: Synthetic oligonucleotide"
cagcagtataataactatcctctcact

SEQ ID NO: 2589 - DNA, 27 bp, Artificial Sequence
  source: /note="Description of Artificial Sequence: Synthetic oligonucleotide"
cagcagtataataactggcctctcact

SEQ ID NO: 2590 - DNA, 27 bp, Artificial Sequence
  source: /note="Description of Artificial Sequence: Synthetic oligonucleotide"
cagcagtataataactggcctctcact

SEQ ID NO: 2591 - DNA, 27 bp, Artificial Sequence
  source: /note="Description of Artificial Sequence: Synthetic oligonucleotide"
cagcagtatggtagttcaccgctcact

SEQ ID NO: 2592 - DNA, 27 bp, Artificial Sequence
  source: /note="Description of Artificial Sequence: Synthetic oligonucleotide"
cagcagtatggtagttcaccgctcact

SEQ ID NO: 2593 - DNA, 27 bp, Artificial Sequence
  source: /note="Description of Artificial Sequence: Synthetic oligonucleotide"
cagcagtatggtagttcaccgctcact

SEQ ID NO: 2594 - DNA, 27 bp, Artificial Sequence
  source: /note="Description of Artificial Sequence: Synthetic oligonucleotide"
cagcagtatggtagttcaccgctcact

SEQ ID NO: 2595 - DNA, 27 bp, Artificial Sequence
  source: /note="Description of Artificial Sequence: Synthetic oligonucleotide"
cagcagtatggtagttcaccgctcact

SEQ ID NO: 2596 - DNA, 27 bp, Artificial Sequence
  source: /note="Description of Artificial Sequence: Synthetic oligonucleotide"
cagcagtatggtagttcaccgctcact

SEQ ID NO: 2597 - DNA, 27 bp, Artificial Sequence
  source: /note="Description of Artificial Sequence: Synthetic oligonucleotide"
cagcagtatggtagttcaccgctcact

SEQ ID NO: 2598 - DNA, 27 bp, Artificial Sequence
  source: /note="Description of Artificial Sequence: Synthetic oligonucleotide"
caacaatattatagtactccgtggacg

SEQ ID NO: 2599 - DNA, 27 bp, Artificial Sequence
  source: /note="Description of Artificial Sequence: Synthetic oligonucleotide"
caacaatattatagtactccgtggacg

SEQ ID NO: 2600 - DNA, 27 bp, Artificial Sequence
  source: /note="Description of Artificial Sequence: Synthetic oligonucleotide"
caacaatattatagtactccgtggacg

SEQ ID NO: 2601 - DNA, 27 bp, Artificial Sequence
  source: /note="Description of Artificial Sequence: Synthetic oligonucleotide"
caacaatattatagtactccgtggacg

SEQ ID NO: 2602 - DNA, 27 bp, Artificial Sequence
  source: /note="Description of Artificial Sequence: Synthetic oligonucleotide"
caacaatattatagtactccgtggacg

SEQ ID NO: 2603 - DNA, 27 bp, Artificial Sequence
  source: /note="Description of Artificial Sequence: Synthetic oligonucleotide"
caacaatattatagtactccgtggacg

SEQ ID NO: 2604 - DNA, 27 bp, Artificial Sequence
  source: /note="Description of Artificial Sequence: Synthetic oligonucleotide"
caacaatattatagtactccgtggacg

SEQ ID NO: 2605 - DNA, 27 bp, Artificial Sequence
  source: /note="Description of Artificial Sequence: Synthetic oligonucleotide"
caacaatattatagtactccgtggacg

SEQ ID NO: 2606 - DNA, 27 bp, Artificial Sequence
  source: /note="Description of Artificial Sequence: Synthetic oligonucleotide"
caacaatattatagtactccgtggacg

SEQ ID NO: 2607 - DNA, 27 bp, Artificial Sequence
  source: /note="Description of Artificial Sequence: Synthetic oligonucleotide"
caacaatattatagtactccgtggacg

SEQ ID NO: 2608 - DNA, 27 bp, Artificial Sequence
  source: /note="Description of Artificial Sequence: Synthetic oligonucleotide"
caacaatattatagtactccgtggacg

SEQ ID NO: 2609 - DNA, 27 bp, Artificial Sequence
  source: /note="Description of Artificial Sequence: Synthetic oligonucleotide"
cagcaatattatcgtactccgtggacg

SEQ ID NO: 2610 - DNA, 27 bp, Artificial Sequence
  source: /note="Description of Artificial Sequence: Synthetic oligonucleotide"
cagcaatattatcgtactccgtggacg

SEQ ID NO: 2611 - DNA, 27 bp, Artificial Sequence
  source: /note="Description of Artificial Sequence: Synthetic oligonucleotide"
cagcaatattatcgtactccgtggacg

SEQ ID NO: 2612 - DNA, 27 bp, Artificial Sequence
  source: /note="Description of Artificial Sequence: Synthetic oligonucleotide"
cagcaatattatcgtactccgtggacg

SEQ ID NO: 2613 - DNA, 27 bp, Artificial Sequence
  source: /note="Description of Artificial Sequence: Synthetic oligonucleotide"
cagcaatattatcgtactccgtggacg

SEQ ID NO: 2614 - DNA, 27 bp, Artificial Sequence
  source: /note="Description of Artificial Sequence: Synthetic oligonucleotide"
cagcaatattatcgtactccgtggacg

SEQ ID NO: 2615 - DNA, 27 bp, Artificial Sequence
  source: /note="Description of Artificial Sequence: Synthetic oligonucleotide"
cagcaatattatcgtactccgtggacg

SEQ ID NO: 2616 - DNA, 27 bp, Artificial Sequence
  source: /note="Description of Artificial Sequence: Synthetic oligonucleotide"
cagcaatattatcgtactccgtggacg

SEQ ID NO: 2617 - DNA, 27 bp, Artificial Sequence
  source: /note="Description of Artificial Sequence: Synthetic oligonucleotide"
cagcaatattatcgtactccgtggacg

SEQ ID NO: 2618 - DNA, 27 bp, Artificial Sequence
  source: /note="Description of Artificial Sequence: Synthetic oligonucleotide"
caacaatattatagtactccgtggacg

SEQ ID NO: 2619 - DNA, 27 bp, Artificial Sequence
  source: /note="Description of Artificial Sequence: Synthetic oligonucleotide"
caacaatattatagtactccgtggacg

SEQ ID NO: 2620 - DNA, 27 bp, Artificial Sequence
  source: /note="Description of Artificial Sequence: Synthetic oligonucleotide"
caacaatattatagtactccgtggacg

SEQ ID NO: 2621 - DNA, 27 bp, Artificial Sequence
  source: /note="Description of Artificial Sequence: Synthetic oligonucleotide"
caacaatattatagtactccgtggacg

SEQ ID NO: 2622 - DNA, 27 bp, Artificial Sequence
  source: /note="Description of Artificial Sequence: Synthetic oligonucleotide"
caacaatattatagtactccgtggacg

SEQ ID NO: 2623 - DNA, 27 bp, Artificial Sequence
  source: /note="Description of Artificial Sequence: Synthetic oligonucleotide"
cagcaatattatcgtactccgtggacg

SEQ ID NO: 2624 - DNA, 27 bp, Artificial Sequence
  source: /note="Description of Artificial Sequence: Synthetic oligonucleotide"
cagcaatattatcgtactccgtggacg

SEQ ID NO: 2625 - DNA, 27 bp, Artificial Sequence
  source: /note="Description of Artificial Sequence: Synthetic oligonucleotide"
cagcaatattatcgtactccgtggacg

SEQ ID NO: 2626 - DNA, 27 bp, Artificial Sequence
  source: /note="Description of Artificial Sequence: Synthetic oligonucleotide"
cagcaatattatcgtactccgtggacg

SEQ ID NO: 2627 - DNA, 27 bp, Artificial Sequence
  source: /note="Description of Artificial Sequence: Synthetic oligonucleotide"
cagcaatattatcgtactccgtggacg

SEQ ID NO: 2628 - DNA, 27 bp, Artificial Sequence
  source: /note="Description of Artificial Sequence: Synthetic oligonucleotide"
cagcaatattatcgtactccgtggacg

SEQ ID NO: 2629 - DNA, 27 bp, Artificial Sequence
  source: /note="Description of Artificial Sequence: Synthetic oligonucleotide"
cagcaatattatcgtactccgtggacg

SEQ ID NO: 2630 - DNA, 27 bp, Artificial Sequence
  source: /note="Description of Artificial Sequence: Synthetic oligonucleotide"
cagcaatattatcgtactccgtggacg

SEQ ID NO: 2631 - DNA, 27 bp, Artificial Sequence
  source: /note="Description of Artificial Sequence: Synthetic oligonucleotide"
cagcaatattatcgtactccgtggacg

SEQ ID NO: 2632 - DNA, 27 bp, Artificial Sequence
  source: /note="Description of Artificial Sequence: Synthetic oligonucleotide"
cagcaatattatcgtactccgtggacg

SEQ ID NO: 2633 - DNA, 27 bp, Artificial Sequence
  source: /note="Description of Artificial Sequence: Synthetic oligonucleotide"
cagcaatattatcgtactccgtggacg

SEQ ID NO: 2634 - DNA, 27 bp, Artificial Sequence
  source: /note="Description of Artificial Sequence: Synthetic oligonucleotide"
cagcaatattatcgtactccgtggacg

SEQ ID NO: 2635 - DNA, 27 bp, Artificial Sequence
  source: /note="Description of Artificial Sequence: Synthetic oligonucleotide"
cagcaatattatcgtactccgtggacg

SEQ ID NO: 2636 - DNA, 33 bp, Artificial Sequence
  source: /note="Description of Artificial Sequence: Synthetic oligonucleotide"
gcaacattcgatgaaagcctgagtggtccggta

SEQ ID NO: 2637 - DNA, 33 bp, Artificial Sequence
  source: /note="Description of Artificial Sequence: Synthetic oligonucleotide"
gcaacattcgatgaaagcctgcaaggtccggta

SEQ ID NO: 2638 - DNA, 33 bp, Artificial Sequence; identical to SEQ ID NO: 2636
  source: /note="Description of Artificial Sequence: Synthetic oligonucleotide"

SEQ ID NO: 2639 - DNA, 33 bp, Artificial Sequence; identical to SEQ ID NO: 2637
  source: /note="Description of Artificial Sequence: Synthetic oligonucleotide"

SEQ ID NO: 2640 - DNA, 33 bp, Artificial Sequence; identical to SEQ ID NO: 2513
  source: /note="Description of Artificial Sequence: Synthetic oligonucleotide"

SEQ ID NO: 2641 - DNA, 33 bp, Artificial Sequence; identical to SEQ ID NO: 2513
  source: /note="Description of Artificial Sequence: Synthetic oligonucleotide"

SEQ ID NO: 2642 - DNA, 33 bp, Artificial Sequence
  source: /note="Description of Artificial Sequence: Synthetic oligonucleotide"
gcaacattcgatgaaagcctgaatggtccggta

SEQ ID NO: 2643 - DNA, 33 bp, Artificial Sequence
  source: /note="Description of Artificial Sequence: Synthetic oligonucleotide"
gcaacattcgatgacagcctgcaaggtccggta

SEQ ID NO: 2644 - DNA, 33 bp, Artificial Sequence
  source: /note="Description of Artificial Sequence: Synthetic oligonucleotide"
gcaacattcgatgacagcctgagtggtccggta

SEQ ID NO: 2645 - DNA, 33 bp, Artificial Sequence
  source: /note="Description of Artificial Sequence: Synthetic oligonucleotide"
gcaacattcgatgacagcctgaatgctccggta

SEQ ID NO: 2646 - DNA, 33 bp, Artificial Sequence
  source: /note="Description of Artificial Sequence: Synthetic oligonucleotide"
gcaacattcgatagcagcctgaatggtccggta

SEQ ID NO: 2647 - DNA, 33 bp, Artificial Sequence
  source: /note="Description of Artificial Sequence: Synthetic oligonucleotide"
gcaacattcgatagcagcctgaatgctccggta

SEQ ID NO: 2648 - DNA, 33 bp, Artificial Sequence; identical to SEQ ID NO: 2647
  source: /note="Description of Artificial Sequence: Synthetic oligonucleotide"

SEQ ID NO: 2649 - DNA, 33 bp, Artificial Sequence; identical to SEQ ID NO: 2636
  source: /note="Description of Artificial Sequence: Synthetic oligonucleotide"

SEQ ID NO: 2650 - DNA, 27 bp, Artificial Sequence
  source: /note="Description of Artificial Sequence: Synthetic oligonucleotide"
ctacagcataataattaccccttcact

SEQ ID NO: 2651 - DNA, 27 bp, Artificial Sequence
  source: /note="Description of Artificial Sequence: Synthetic oligonucleotide"
ctacagcataataattaccccttcact

SEQ ID NO: 2652 - DNA, 33 bp, Artificial Sequence
  source: /note="Description of Artificial Sequence: Synthetic oligonucleotide"
gcaacattcgatagcagcctgagtggtccggta

SEQ ID NO: 2653 - DNA, 27 bp, Artificial Sequence
  source: /note="Description of Artificial Sequence: Synthetic oligonucleotide"
caacagagttacagtaccctgatcagt

SEQ ID NO: 2654 - DNA, 33 bp, Artificial Sequence
  source: /note="Description of Artificial Sequence: Synthetic oligonucleotide"
ggaacatgggatagcagcctgagtgctgtggta

SEQ ID NO: 2655 - DNA, 27 bp, Artificial Sequence
  source: /note="Description of Artificial Sequence: Synthetic oligonucleotide"
caacagagttacagtaccctgatcagt

SEQ ID NO: 2656 - DNA, 27 bp, Artificial Sequence
  source: /note="Description of Artificial Sequence: Synthetic oligonucleotide"
caacagagttacagtaccctgatcagt

SEQ ID NO: 2657 - DNA, 27 bp, Artificial Sequence
  source: /note="Description of Artificial Sequence: Synthetic oligonucleotide"
caacagagttacagtaccctgatcagt

SEQ ID NO: 2658 - DNA, 27 bp, Artificial Sequence
  source: /note="Description of Artificial Sequence: Synthetic oligonucleotide"
caacagagttacagtaccctgatcagt

SEQ ID NO: 2659 - DNA, 27 bp, Artificial Sequence
  source: /note="Description of Artificial Sequence: Synthetic oligonucleotide"
caacagagttacagtaccctgatcagt

SEQ ID NO: 2660 - DNA, 27 bp, Artificial Sequence
  source: /note="Description of Artificial Sequence: Synthetic oligonucleotide"
caacagagttacagtaccctgatcagt

SEQ ID NO: 2661 - DNA, 33 bp, Artificial Sequence; identical to SEQ ID NO: 2654
  source: /note="Description of Artificial Sequence: Synthetic oligonucleotide"

SEQ ID NO: 2662 - DNA, 33 bp, Artificial Sequence; identical to SEQ ID NO: 2654
  source: /note="Description of Artificial Sequence: Synthetic oligonucleotide"

SEQ ID NO: 2663 - DNA, 33 bp, Artificial Sequence; identical to SEQ ID NO: 2654
  source: /note="Description of Artificial Sequence: Synthetic oligonucleotide"

SEQ ID NO: 2664 - DNA, 33 bp, Artificial Sequence
  source: /note="Description of Artificial Sequence: Synthetic oligonucleotide"
ggaacattcgaaagcagcctgagtgctgtggta

SEQ ID NO: 2665 - DNA, 33 bp, Artificial Sequence; identical to SEQ ID NO: 2654
  source: /note="Description of Artificial Sequence: Synthetic oligonucleotide"

SEQ ID NO: 2666 - DNA, 33 bp, Artificial Sequence; identical to SEQ ID NO: 2654
  source: /note="Description of Artificial Sequence: Synthetic oligonucleotide"

SEQ ID NO: 2667 - DNA, 33 bp, Artificial Sequence; identical to SEQ ID NO: 2654
  source: /note="Description of Artificial Sequence: Synthetic oligonucleotide"

SEQ ID NO: 2668 - DNA, 33 bp, Artificial Sequence; identical to SEQ ID NO: 2664
  source: /note="Description of Artificial Sequence: Synthetic oligonucleotide"

SEQ ID NO: 2669 - DNA, 27 bp, Artificial Sequence
  source: /note="Description of Artificial Sequence: Synthetic oligonucleotide"
caacagagttacagtaccctgctcagt

SEQ ID NO: 2670 - DNA, 15 bp, Artificial Sequence
  source: /note="Description of Artificial Sequence: Synthetic oligonucleotide"
ggctactatatgcat

SEQ ID NO: 2671 - DNA, 15 bp, Artificial Sequence
  source: /note="Description of Artificial Sequence: Synthetic oligonucleotide"
aactttggcatgcac

SEQ ID NO: 2672 - DNA, 15 bp, Artificial Sequence
  source: /note="Description of Artificial Sequence: Synthetic oligonucleotide"
tactttggcatgcac

SEQ ID NO: 2673 - DNA, 15 bp, Artificial Sequence
  source: /note="Description of Artificial Sequence: Synthetic oligonucleotide"
agctatggcatgcac

SEQ ID NO: 2674 - DNA, 15 bp, Artificial Sequence
  source: /note="Description of Artificial Sequence: Synthetic oligonucleotide"
ggctactatatccac

SEQ ID NO: 2675 - DNA, 15 bp, Artificial Sequence
  source: /note="Description of Artificial Sequence: Synthetic oligonucleotide"
ggctactatatccac

SEQ ID NO: 2676 - DNA, 15 bp, Artificial Sequence
  source: /note="Description of Artificial Sequence: Synthetic oligonucleotide"
ggctactatatacac

SEQ ID NO: 2677 - DNA, 15 bp, Artificial Sequence
  source: /note="Description of Artificial Sequence: Synthetic oligonucleotide"
ggctactatatacac

SEQ ID NO: 2678 - DNA, 21 bp, Artificial Sequence
  source: /note="Description of Artificial Sequence: Synthetic oligonucleotide"
agtggtggttactactggagc

SEQ ID NO: 2679 - DNA, 15 bp, Artificial Sequence
  source: /note="Description of Artificial Sequence: Synthetic oligonucleotide"
aactatggcatgcac

SEQ ID NO: 2680 - DNA, 15 bp, Artificial Sequence
  source: /note="Description of Artificial Sequence: Synthetic oligonucleotide"
tactttggcatgcac

SEQ ID NO: 2681 - DNA, 15 bp, Artificial Sequence
  source: /note="Description of Artificial Sequence: Synthetic oligonucleotide"
agctatggcatgcac

SEQ ID NO: 2682 - DNA, 15 bp, Artificial Sequence
  source: /note="Description of Artificial Sequence: Synthetic oligonucleotide"
agttactactggagc

SEQ ID NO: 2683 - DNA, 15 bp, Artificial Sequence
  source: /note="Description of Artificial Sequence: Synthetic oligonucleotide"
agttactactggagc

SEQ ID NO: 2684 - DNA, 15 bp, Artificial Sequence
  source: /note="Description of Artificial Sequence: Synthetic oligonucleotide"
tactttggcatgcac

SEQ ID NO: 2685 - DNA, 15 bp, Artificial Sequence
  source: /note="Description of Artificial Sequence: Synthetic oligonucleotide"
tactttggcatgcac

SEQ ID NO: 2686 - DNA, 15 bp, Artificial Sequence
  source: /note="Description of Artificial Sequence: Synthetic oligonucleotide"
tactttggcatgcac

SEQ ID NO: 2687 - DNA, 15 bp, Artificial Sequence
  source: /note="Description of Artificial Sequence: Synthetic oligonucleotide"
tactttggcatgcac

SEQ ID NO: 2688 - DNA, 15 bp, Artificial Sequence
  source: /note="Description of Artificial Sequence: Synthetic oligonucleotide"
tactttggcatgcac

SEQ ID NO: 2689 - DNA, 15 bp, Artificial Sequence
  source: /note="Description of Artificial Sequence: Synthetic oligonucleotide"
tactttggcatgcac

SEQ ID NO: 2690 - DNA, 15 bp, Artificial Sequence
  source: /note="Description of Artificial Sequence: Synthetic oligonucleotide"
aactttggcatgcac

SEQ ID NO: 2691 - DNA, 15 bp, Artificial Sequence
  source: /note="Description of Artificial Sequence: Synthetic oligonucleotide"
aactttggcatgcac

SEQ ID NO: 2692 - DNA, 15 bp, Artificial Sequence
  source: /note="Description of Artificial Sequence: Synthetic oligonucleotide"
aactttggcatgcac

SEQ ID NO: 2693 - DNA, 15 bp, Artificial Sequence
  source: /note="Description of Artificial Sequence: Synthetic oligonucleotide"
aactttggcatgcac

SEQ ID NO: 2694 - DNA, 15 bp, Artificial Sequence
  source: /note="Description of Artificial Sequence: Synthetic oligonucleotide"
aactttggcatgcac

SEQ ID NO: 2695 - DNA, 15 bp, Artificial Sequence
  source: /note="Description of Artificial Sequence: Synthetic oligonucleotide"
aactttggcatgcac

SEQ ID NO: 2696 - DNA, 15 bp, Artificial Sequence
  source: /note="Description of Artificial Sequence: Synthetic oligonucleotide"
aactttggcatgcac

SEQ ID NO: 2697 - DNA, 15 bp, Artificial Sequence
  source: /note="Description of Artificial Sequence: Synthetic oligonucleotide"
aactttggcatgcac

SEQ ID NO: 2698 - DNA, 15 bp, Artificial Sequence
  source: /note="Description of Artificial Sequence: Synthetic oligonucleotide"
aactttggcatgcac

SEQ ID NO: 2699 - DNA, 15 bp, Artificial Sequence
  source: /note="Description of Artificial Sequence: Synthetic oligonucleotide"
aactttggcatgcac

SEQ ID NO: 2700 - DNA, 15 bp, Artificial Sequence
  source: /note="Description of Artificial Sequence: Synthetic oligonucleotide"
aactttggcatgcac

SEQ ID NO: 2701 - DNA, 15 bp, Artificial Sequence
  source: /note="Description of Artificial Sequence: Synthetic oligonucleotide"
aactttggcatgcac

SEQ ID NO: 2702 - DNA, 15 bp, Artificial Sequence
  source: /note="Description of Artificial Sequence: Synthetic oligonucleotide"
aactttggcatgcac

SEQ ID NO: 2703 - DNA, 15 bp, Artificial Sequence
  source: /note="Description of Artificial Sequence: Synthetic oligonucleotide"
aactttggcatgcac

SEQ ID NO: 2704 - DNA, 15 bp, Artificial Sequence
  source: /note="Description of Artificial Sequence: Synthetic oligonucleotide"
aactttggcatgcac

SEQ ID NO: 2705 - DNA, 15 bp, Artificial Sequence
  source: /note="Description of Artificial Sequence: Synthetic oligonucleotide"
aactttggcatgcac

SEQ ID NO: 2706 - DNA, 15 bp, Artificial Sequence
  source: /note="Description of Artificial Sequence: Synthetic oligonucleotide"
aactttggcatgcac

SEQ ID NO: 2707 - DNA, 15 bp, Artificial Sequence
  source: /note="Description of Artificial Sequence: Synthetic oligonucleotide"
aactttggcatgcac

SEQ ID NO: 2708 - DNA, 15 bp, Artificial Sequence
  source: /note="Description of Artificial Sequence: Synthetic oligonucleotide"
aactttggcatgcac

SEQ ID NO: 2709 - DNA, 15 bp, Artificial Sequence
  source: /note="Description of Artificial Sequence: Synthetic oligonucleotide"
agctatggcatgcac

SEQ ID NO: 2710 - DNA, 15 bp, Artificial Sequence
  source: /note="Description of Artificial Sequence: Synthetic oligonucleotide"
agctatggcatgcac

SEQ ID NO: 2711 - DNA, 15 bp, Artificial Sequence
  source: /note="Description of Artificial Sequence: Synthetic oligonucleotide"
agctatggcatgcac

SEQ ID NO: 2712 - DNA, 15 bp, Artificial Sequence
  source: /note="Description of Artificial Sequence: Synthetic oligonucleotide"
agctatggcatgcac

SEQ ID NO: 2713 - DNA, 15 bp, Artificial Sequence
  source: /note="Description of Artificial Sequence: Synthetic oligonucleotide"
agctatggcatgcac

SEQ ID NO: 2714 - DNA, 15 bp, Artificial Sequence
  source: /note="Description of Artificial Sequence: Synthetic oligonucleotide"
agctatggcatgcac

SEQ ID NO: 2715 - DNA, 15 bp, Artificial Sequence
  source: /note="Description of Artificial Sequence: Synthetic oligonucleotide"
agctatggcatgcac

SEQ ID NO: 2716 - DNA, 15 bp, Artificial Sequence
  source: /note="Description of Artificial Sequence: Synthetic oligonucleotide"
agctatggcatgcac

SEQ ID NO: 2717 - DNA, 15 bp, Artificial Sequence
  source: /note="Description of Artificial Sequence: Synthetic oligonucleotide"
agctatggcatgcac

SEQ ID NO: 2718 - DNA, 15 bp, Artificial Sequence
  source: /note="Description of Artificial Sequence: Synthetic oligonucleotide"
tactttggcatgcac

SEQ ID NO: 2719 - DNA, 15 bp, Artificial Sequence
  source: /note="Description of Artificial Sequence: Synthetic oligonucleotide"
tactttggcatgcac

SEQ ID NO: 2720 - DNA, 15 bp, Artificial Sequence
  source: /note="Description of Artificial Sequence: Synthetic oligonucleotide"
tactttggcatgcac

SEQ ID NO: 2721 - DNA, 15 bp, Artificial Sequence
  source: /note="Description of Artificial Sequence: Synthetic oligonucleotide"
tactttggcatgcac

SEQ ID NO: 2722 - DNA, 15 bp, Artificial Sequence
  source: /note="Description of Artificial Sequence: Synthetic oligonucleotide"
tactttggcatgcac

SEQ ID NO: 2723 - DNA, 15 bp, Artificial Sequence
  source: /note="Description of Artificial Sequence: Synthetic oligonucleotide"
tactttggcatgcac

SEQ ID NO: 2724 - DNA, 15 bp, Artificial Sequence
  source: /note="Description of Artificial Sequence: Synthetic oligonucleotide"
tactttggcatgcac

SEQ ID NO: 2725 - DNA, 15 bp, Artificial Sequence
  source: /note="Description of Artificial Sequence: Synthetic oligonucleotide"
agctatggcatgcac

SEQ ID NO: 2726 - DNA, 15 bp, Artificial Sequence
  source: /note="Description of Artificial Sequence: Synthetic oligonucleotide"
agctatggcatgcac

SEQ ID NO: 2727 - DNA, 15 bp, Artificial Sequence
  source: /note="Description of Artificial Sequence: Synthetic oligonucleotide"
agctatggcatgcac

SEQ ID NO: 2728 - DNA, 15 bp, Artificial Sequence
  source: /note="Description of Artificial Sequence: Synthetic oligonucleotide"
agctatggcatgcac

SEQ ID NO: 2729 - DNA, 15 bp, Artificial Sequence
  source: /note="Description of Artificial Sequence: Synthetic oligonucleotide"
agctatggcatgcac

SEQ ID NO: 2730 - DNA, 15 bp, Artificial Sequence
  source: /note="Description of Artificial Sequence: Synthetic oligonucleotide"
agctatggcatgcac

SEQ ID NO: 2731 - DNA, 15 bp, Artificial Sequence
  source: /note="Description of Artificial Sequence: Synthetic oligonucleotide"
agctatggcatgcac

SEQ ID NO: 2732 - DNA, 15 bp, Artificial Sequence
  source: /note="Description of Artificial Sequence: Synthetic oligonucleotide"
agctatggcatgcac

SEQ ID NO: 2733 - DNA, 15 bp, Artificial Sequence
  source: /note="Description of Artificial Sequence: Synthetic oligonucleotide"
agctatggcatgcac

SEQ ID NO: 2734 - DNA, 15 bp, Artificial Sequence
  source: /note="Description of Artificial Sequence: Synthetic oligonucleotide"
agctatggcatgcac

SEQ ID NO: 2735 - DNA, 15 bp, Artificial Sequence
  source: /note="Description of Artificial Sequence: Synthetic oligonucleotide"
agctatggcatgcac

SEQ ID NO: 2736 - DNA, 15 bp, Artificial Sequence
  source: /note="Description of Artificial Sequence: Synthetic oligonucleotide"
agctatggcatgcac

SEQ ID NO: 2737 - DNA, 15 bp, Artificial Sequence
  source: /note="Description of Artificial Sequence: Synthetic oligonucleotide"
agctatggcatgcac

SEQ ID NO: 2738 - DNA, 15 bp, Artificial Sequence
  source: /note="Description of Artificial Sequence: Synthetic oligonucleotide"
agctatggcatgcac

SEQ ID NO: 2739 - DNA, 15 bp, Artificial Sequence
  source: /note="Description of Artificial Sequence: Synthetic oligonucleotide"
agctatggcatgcac

SEQ ID NO: 2740 - DNA, 15 bp, Artificial Sequence
  source: /note="Description of Artificial Sequence: Synthetic oligonucleotide"
aactatggcatgcac

SEQ ID NO: 2741 - DNA, 15 bp, Artificial Sequence
  source: /note="Description of Artificial Sequence: Synthetic oligonucleotide"
aactatggcatgcac

SEQ ID NO: 2742 - DNA, 15 bp, Artificial Sequence
  source: /note="Description of Artificial Sequence: Synthetic oligonucleotide"
aactatggcatgcac

SEQ ID NO: 2743 - DNA, 15 bp, Artificial Sequence
  source: /note="Description of Artificial Sequence: Synthetic oligonucleotide"
aactatggcatgcac

SEQ ID NO: 2744 - DNA, 15 bp, Artificial Sequence
  source: /note="Description of Artificial Sequence: Synthetic oligonucleotide"
aactatggcatgcac

SEQ ID NO: 2745 - DNA, 15 bp, Artificial Sequence
  source: /note="Description of Artificial Sequence: Synthetic oligonucleotide"
aactatggcatgcac

SEQ ID NO: 2746 - DNA, 15 bp, Artificial Sequence
  source: /note="Description of Artificial Sequence: Synthetic oligonucleotide"
aactatggcatgcac

SEQ ID NO: 2747 - DNA, 15 bp, Artificial Sequence
  source: /note="Description of Artificial Sequence: Synthetic oligonucleotide"
aactatggcatgcac

SEQ ID NO: 2748 - DNA, 21 bp, Artificial Sequence
  source: /note="Description of Artificial Sequence: Synthetic oligonucleotide"
agtggtggttactactggagc

SEQ ID NO: 2749 - DNA, 21 bp, Artificial Sequence
  source: /note="Description of Artificial Sequence: Synthetic oligonucleotide"
agtggtggttactactggagc

SEQ ID NO: 2750 - DNA, 21 bp, Artificial Sequence
  source: /note="Description of Artificial Sequence: Synthetic oligonucleotide"
agtggtggttactactggagc

SEQ ID NO: 2751 - DNA, 21 bp, Artificial Sequence
  source: /note="Description of Artificial Sequence: Synthetic oligonucleotide"
agtggtggttactactggagc

SEQ ID NO: 2752 - DNA, 21 bp, Artificial Sequence
  source: /note="Description of Artificial Sequence: Synthetic oligonucleotide"
agtggtggttactactggagc

SEQ ID NO: 2753 - DNA, 21 bp, Artificial Sequence
  source: /note="Description of Artificial Sequence: Synthetic oligonucleotide"
agtggtggttactactggagc

SEQ ID NO: 2754 - DNA, 21 bp, Artificial Sequence
  source: /note="Description of Artificial Sequence: Synthetic oligonucleotide"
agtggtggttactactggagc

SEQ ID NO: 2755 - DNA, 15 bp, Artificial Sequence
  source: /note="Description of Artificial Sequence: Synthetic oligonucleotide"
ggctactatatccac

SEQ ID NO: 2756 - DNA, 15 bp, Artificial Sequence
  source: /note="Description of Artificial Sequence: Synthetic oligonucleotide"
ggctactatatccac

SEQ ID NO: 2757 - DNA, 15 bp, Artificial Sequence
  source: /note="Description of Artificial Sequence: Synthetic oligonucleotide"
ggctactatatccac

SEQ ID NO: 2758 - DNA, 15 bp, Artificial Sequence
  source: /note="Description of Artificial Sequence: Synthetic oligonucleotide"
ggctactatatccac

SEQ ID NO: 2759 - DNA, 15 bp, Artificial Sequence
  source: /note="Description of Artificial Sequence: Synthetic oligonucleotide"
ggctactatatccac

SEQ ID NO: 2760 - DNA, 15 bp, Artificial Sequence
  source: /note="Description of Artificial Sequence: Synthetic oligonucleotide"
ggctactatatccac

SEQ ID NO: 2761 - DNA, 15 bp, Artificial Sequence
  source: /note="Description of Artificial Sequence: Synthetic oligonucleotide"
ggctactatatccac

SEQ ID NO: 2762 - DNA, 15 bp, Artificial Sequence
  source: /note="Description of Artificial Sequence: Synthetic oligonucleotide"
ggctactatatccac

SEQ ID NO: 2763 - DNA, 15 bp, Artificial Sequence
  source: /note="Description of Artificial Sequence: Synthetic oligonucleotide"
ggctactatatccac

SEQ ID NO: 2764 - DNA, 15 bp, Artificial Sequence
  source: /note="Description of Artificial Sequence: Synthetic oligonucleotide"
ggctactatatccac

SEQ ID NO: 2765 - DNA, 15 bp, Artificial Sequence
  source: /note="Description of Artificial Sequence: Synthetic oligonucleotide"
ggctactatatccac

SEQ ID NO: 2766 - DNA, 15 bp, Artificial Sequence
  source: /note="Description of Artificial Sequence: Synthetic oligonucleotide"
ggctactatatacac

SEQ ID NO: 2767 - DNA, 15 bp, Artificial Sequence
  source: /note="Description of Artificial Sequence: Synthetic oligonucleotide"
ggctactatatacac

SEQ ID NO: 2768 - DNA, 15 bp, Artificial Sequence
  source: /note="Description of Artificial Sequence: Synthetic oligonucleotide"
ggctactatatacac

SEQ ID NO: 2769 - DNA, 15 bp, Artificial Sequence
  source: /note="Description of Artificial Sequence: Synthetic oligonucleotide"
ggctactatatacac

SEQ ID NO: 2770 - DNA, 15 bp, Artificial Sequence
  source: /note="Description of Artificial Sequence: Synthetic oligonucleotide"
ggctactatatacac

SEQ ID NO: 2771 - DNA, 15 bp, Artificial Sequence
  source: /note="Description of Artificial Sequence: Synthetic oligonucleotide"
ggctactatatacac

SEQ ID NO: 2772 - DNA, 15 bp, Artificial Sequence
  source: /note="Description of Artificial Sequence: Synthetic oligonucleotide"
ggctactatatacac

SEQ ID NO: 2773 - DNA, 15 bp, Artificial Sequence
  source: /note="Description of Artificial Sequence: Synthetic oligonucleotide"
ggctactatatacac

SEQ ID NO: 2774 - DNA, 15 bp, Artificial Sequence
  source: /note="Description of Artificial Sequence: Synthetic oligonucleotide"
ggctactatatacac

SEQ ID NO: 2775 - DNA, 15 bp, Artificial Sequence
  source: /note="Description of Artificial Sequence: Synthetic oligonucleotide"
ggctactatatccac

SEQ ID NO: 2776 - DNA, 15 bp, Artificial Sequence
  source: /note="Description of Artificial Sequence: Synthetic oligonucleotide"
ggctactatatccac

SEQ ID NO: 2777 - DNA, 15 bp, Artificial Sequence
  source: /note="Description of Artificial Sequence: Synthetic oligonucleotide"
ggctactatatccac

SEQ ID NO: 2778 - DNA, 15 bp, Artificial Sequence
  source: /note="Description of Artificial Sequence: Synthetic oligonucleotide"
ggctactatatccac

SEQ ID NO: 2779 - DNA, 15 bp, Artificial Sequence
  source: /note="Description of Artificial Sequence: Synthetic oligonucleotide"
ggctactatatccac

SEQ ID NO: 2780 - DNA, 15 bp, Artificial Sequence
  source: /note="Description of Artificial Sequence: Synthetic oligonucleotide"
ggctactatatacac

SEQ ID NO: 2781 - DNA, 15 bp, Artificial Sequence
  source: /note="Description of Artificial Sequence: Synthetic oligonucleotide"
ggctactatatacac

SEQ ID NO: 2782 - DNA, 15 bp, Artificial Sequence
  source: /note="Description of Artificial Sequence: Synthetic oligonucleotide"
ggctactatatacac

SEQ ID NO: 2783 - DNA, 15 bp, Artificial Sequence
  source: /note="Description of Artificial Sequence: Synthetic oligonucleotide"
ggctactatatacac

SEQ ID NO: 2784 - DNA, 15 bp, Artificial Sequence
  source: /note="Description of Artificial Sequence: Synthetic oligonucleotide"
ggctactatatacac

SEQ ID NO: 2785 - DNA, 15 bp, Artificial Sequence
  source: /note="Description of Artificial Sequence: Synthetic oligonucleotide"
ggctactatatacac

SEQ ID NO: 2786 - DNA, 15 bp, Artificial Sequence
  source: /note="Description of Artificial Sequence: Synthetic oligonucleotide"
ggctactatatacac

SEQ ID NO: 2787 - DNA, 15 bp, Artificial Sequence
  source: /note="Description of Artificial Sequence: Synthetic oligonucleotide"
ggctactatatacac

SEQ ID NO: 2788 - DNA, 15 bp, Artificial Sequence
  source: /note="Description of Artificial Sequence: Synthetic oligonucleotide"
ggctactatatacac

SEQ ID NO: 2789 - DNA, 15 bp, Artificial Sequence
  source: /note="Description of Artificial Sequence: Synthetic oligonucleotide"
ggctactatatacac

SEQ ID NO: 2790 - DNA, 15 bp, Artificial Sequence
  source: /note="Description of Artificial Sequence: Synthetic oligonucleotide"
ggctactatatacac

SEQ ID NO: 2791 - DNA, 15 bp, Artificial Sequence
  source: /note="Description of Artificial Sequence: Synthetic oligonucleotide"
ggctactatatacac

SEQ ID NO: 2792 - DNA, 15 bp, Artificial Sequence
  source: /note="Description of Artificial Sequence: Synthetic oligonucleotide"
ggctactatatacac

SEQ ID NO: 2793 - DNA, 15 bp, Artificial Sequence
  source: /note="Description of Artificial Sequence: Synthetic oligonucleotide"
ggctactatatgcat

SEQ ID NO: 2794 - DNA, 15 bp, Artificial Sequence
  source: /note="Description of Artificial Sequence: Synthetic oligonucleotide"
ggctactatatgcat

SEQ ID NO: 2795 - DNA, 15 bp, Artificial Sequence
  source: /note="Description of Artificial Sequence: Synthetic oligonucleotide"
ggctactatatgcat

SEQ ID NO: 2796 - DNA, 15 bp, Artificial Sequence
  source: /note="Description of Artificial Sequence: Synthetic oligonucleotide"
ggctactatatgcat

SEQ ID NO: 2797 - DNA, 15 bp, Artificial Sequence
  source: /note="Description of Artificial Sequence: Synthetic oligonucleotide"
ggctactatatgcat

SEQ ID NO: 2798 - DNA, 15 bp, Artificial Sequence
  source: /note="Description of Artificial Sequence: Synthetic oligonucleotide"
ggctactatatgcat

SEQ ID NO: 2799 - DNA, 15 bp, Artificial Sequence
  source: /note="Description of Artificial Sequence: Synthetic oligonucleotide"
ggctactatatgcat

SEQ ID NO: 2800 - DNA, 15 bp, Artificial Sequence
  source: /note="Description of Artificial Sequence: Synthetic oligonucleotide"
ggctactatatgcat

SEQ ID NO: 2801 - DNA, 15 bp, Artificial Sequence
  source: /note="Description of Artificial Sequence: Synthetic oligonucleotide"
ggctactatatgcat

SEQ ID NO: 2802 - DNA, 15 bp, Artificial Sequence
  source: /note="Description of Artificial Sequence: Synthetic oligonucleotide"
ggctactatatgcat

SEQ ID NO: 2803 - DNA, 15 bp, Artificial Sequence
  source: /note="Description of Artificial Sequence: Synthetic oligonucleotide"
ggctactatatgcat

SEQ ID NO: 2804 - DNA, 15 bp, Artificial Sequence
  source: /note="Description of Artificial Sequence: Synthetic oligonucleotide"
ggctactatatgcat

SEQ ID NO: 2805 - DNA, 15 bp, Artificial Sequence
  source: /note="Description of Artificial Sequence: Synthetic oligonucleotide"
ggctactatatgcat

SEQ ID NO: 2806 - DNA, 15 bp, Artificial Sequence
  source: /note="Description of Artificial Sequence: Synthetic oligonucleotide"
ggctactatatgcat

SEQ ID NO: 2807 - DNA, 15 bp, Artificial Sequence
  source: /note="Description of Artificial Sequence: Synthetic oligonucleotide"
aactttggcatgcac

SEQ ID NO: 2808 - DNA, 15 bp, Artificial Sequence
  source: /note="Description of Artificial Sequence: Synthetic oligonucleotide"
tactttggcatgcac

SEQ ID NO: 2809 - DNA, 15 bp, Artificial Sequence
  source: /note="Description of Artificial Sequence: Synthetic oligonucleotide"
ggctactatatgcat

SEQ ID NO: 2810 - DNA, 15 bp, Artificial Sequence
  source: /note="Description of Artificial Sequence: Synthetic oligonucleotide"
agctatggcatacac

SEQ ID NO: 2811 - DNA, 15 bp, Artificial Sequence
  source: /note="Description of Artificial Sequence: Synthetic oligonucleotide"
agttatgatatcaac

SEQ ID NO: 2812 - DNA, 15 bp, Artificial Sequence
  source: /note="Description of Artificial Sequence: Synthetic oligonucleotide"
agctatggcatacac

SEQ ID NO: 2813 - DNA, 15 bp, Artificial Sequence
  source: /note="Description of Artificial Sequence: Synthetic oligonucleotide"
agctatggcatacac

SEQ ID NO: 2814 - DNA, 15 bp, Artificial Sequence
  source: /note="Description of Artificial Sequence: Synthetic oligonucleotide"
agctatggcatacac

SEQ ID NO: 2815 - DNA, 15 bp, Artificial Sequence
  source: /note="Description of Artificial Sequence: Synthetic oligonucleotide"
agctatggcatacac

SEQ ID NO: 2816 - DNA, 15 bp, Artificial Sequence
  source: /note="Description of Artificial Sequence: Synthetic oligonucleotide"
agctatggcatacac

SEQ ID NO: 2817 - DNA, 15 bp, Artificial Sequence
  source: /note="Description of Artificial Sequence: Synthetic oligonucleotide"
agctatggcatacac

SEQ ID NO: 2818 - DNA, 15 bp, Artificial Sequence
  source: /note="Description of Artificial Sequence: Synthetic oligonucleotide"
agttatgatatcaac

SEQ ID NO: 2819 - DNA, 15 bp, Artificial Sequence
  source: /note="Description of Artificial Sequence: Synthetic oligonucleotide"
agttatgatatcaac

SEQ ID NO: 2820 - DNA, 15 bp, Artificial Sequence
  source: /note="Description of Artificial Sequence: Synthetic oligonucleotide"
agttatgatatcaac

SEQ ID NO: 2821 - DNA, 15 bp, Artificial Sequence
  source: /note="Description of Artificial Sequence: Synthetic oligonucleotide"
agttatgatatcaac

SEQ ID NO: 2822 - DNA, 15 bp, Artificial Sequence
  source: /note="Description of Artificial Sequence: Synthetic oligonucleotide"
agttatgatatcaac

SEQ ID NO: 2823 - DNA, 15 bp, Artificial Sequence
  source: /note="Description of Artificial Sequence: Synthetic oligonucleotide"
agttatgatatcaac

SEQ ID NO: 2824 - DNA, 15 bp, Artificial Sequence
  source: /note="Description of Artificial Sequence: Synthetic oligonucleotide"
agttatgatatcaac

SEQ ID NO: 2825 - DNA, 15 bp, Artificial Sequence
  source: /note="Description of Artificial Sequence: Synthetic oligonucleotide"
agttatgatatcaac

SEQ ID NO: 2826 - DNA, 15 bp, Artificial Sequence
  source: /note="Description of Artificial Sequence: Synthetic oligonucleotide"
agctatggcatacac

SEQ ID NO: 2827 - DNA, 51 bp, Artificial Sequence
  source: /note="Description of Artificial Sequence: Synthetic oligonucleotide"
tggatcaaccctaacagtggtggcacaaactatgcacagaagtttcagggc

SEQ ID NO: 2828 - DNA, 51 bp, Artificial Sequence
  source: /note="Description of Artificial Sequence: Synthetic oligonucleotide"
gttatatggtatgatggaagtaatgaaaactatgcagactccgtgaagggc

SEQ ID NO: 2829 - DNA, 51 bp, Artificial Sequence
  source: /note="Description of Artificial Sequence: Synthetic oligonucleotide"
gttatatggtatgatggaagtaataaatactatgcagactccgtgaagggc

SEQ ID NO: 2830 - DNA, 51 bp, Artificial Sequence; identical to SEQ ID NO: 2829
  source: /note="Description of Artificial Sequence: Synthetic oligonucleotide"

SEQ ID NO: 2831 - DNA, 51 bp, Artificial Sequence
  source: /note="Description of Artificial Sequence: Synthetic oligonucleotide"
tggatcaaccctgacagtggtggcacagactattcacagaggtttcagggc

SEQ ID NO: 2832 - DNA, 51 bp, Artificial Sequence; identical to SEQ ID NO: 2831
  source: /note="Description of Artificial Sequence: Synthetic oligonucleotide"

SEQ ID NO: 2833 - DNA, 51 bp, Artificial Sequence
  source: /note="Description of Artificial Sequence: Synthetic oligonucleotide"
tggatcagccctaacagtggtgacacaagctatgcacagaagtttcaggac

SEQ ID NO: 2834 - DNA, 51 bp, Artificial Sequence
  source: /note="Description of Artificial Sequence: Synthetic oligonucleotide"
tggataagccctaacaatggtgacacaaactatgcacagaagtttcaggac

SEQ ID NO: 2835 - DNA, 48 bp, Artificial Sequence
  source: /note="Description of Artificial Sequence: Synthetic oligonucleotide"
tacatctattacagtgggagcacctactacaacccgtccctcaagagt

SEQ ID NO: 2836 - DNA, 51 bp, Artificial Sequence
  source: /note="Description of Artificial Sequence: Synthetic oligonucleotide"
gctatatggtttgatggaagtgataaatactatgcagactccgtgaagggc

SEQ ID NO: 2837 - DNA, 51 bp, Artificial Sequence; identical to SEQ ID NO: 2829
  source: /note="Description of Artificial Sequence: Synthetic oligonucleotide"

SEQ ID NO: 2838 - DNA, 51 bp, Artificial Sequence
  source: /note="Description of Artificial Sequence: Synthetic oligonucleotide"
gctatatggtatgatggaaataataaatactatgcagactccgtgaagggc

SEQ ID NO: 2839 - DNA, 48 bp, Artificial Sequence
  source: /note="Description of Artificial Sequence: Synthetic oligonucleotide"
cgtatctataccagtgggagcaccaactacaacccctccctcaagagt

SEQ ID NO: 2840 - DNA, 48 bp, Artificial Sequence; identical to SEQ ID NO: 2839
  source: /note="Description of Artificial Sequence: Synthetic oligonucleotide"

SEQ ID NO: 2841 - DNA, 51 bp, Artificial Sequence
  source: /note="Description of Artificial Sequence: Synthetic oligonucleotide"
gttatatggtatgatgcaagtaataaatactatgcagacgccgtgaagggc

SEQ ID NO: 2842 - DNA, 51 bp, Artificial Sequence
  source: /note="Description of Artificial Sequence: Synthetic oligonucleotide"
gttatatggtatgatgcaagtaataaatactatgcagactccgtgaagggc

SEQ ID NO: 2843 - DNA, 51 bp, Artificial Sequence
  source: /note="Description of Artificial Sequence: Synthetic oligonucleotide"
gttatatggtatgatggaagtaataaatactatgcagacgccgtgaagggc

SEQ ID NO: 2844 - DNA, 51 bp, Artificial Sequence; identical to SEQ ID NO: 2841
  source: /note="Description of Artificial Sequence: Synthetic oligonucleotide"

SEQ ID NO: 2845 - DNA, 51 bp, Artificial Sequence; identical to SEQ ID NO: 2841
  source: /note="Description of Artificial Sequence: Synthetic oligonucleotide"

SEQ ID NO: 2846 - DNA, 51 bp, Artificial Sequence; identical to SEQ ID NO: 2841
  source: /note="Description of Artificial Sequence: Synthetic oligonucleotide"

SEQ ID NO: 2847 - DNA, 51 bp, Artificial Sequence
  source: /note="Description of Artificial Sequence: Synthetic oligonucleotide"
gttatatggtatgatgcaagtaatgaaaactatgcagacgccgtgaagggc

SEQ ID NO: 2848 - DNA, 51 bp, Artificial Sequence; identical to SEQ ID NO: 2847
  source: /note="Description of Artificial Sequence: Synthetic oligonucleotide"

SEQ ID NO: 2849 - DNA, 51 bp, Artificial Sequence; identical to SEQ ID NO: 2847
  source: /note="Description of Artificial Sequence: Synthetic oligonucleotide"

SEQ ID NO: 2850 - DNA, 51 bp, Artificial Sequence
  source: /note="Description of Artificial Sequence: Synthetic oligonucleotide"
gttatatggtatgatgcaagtaatgaaaactatgcagactccgtgaagggc

SEQ ID NO: 2851 - DNA, 51 bp, Artificial Sequence
  source: /note="Description of Artificial Sequence: Synthetic oligonucleotide"
gttatatggtatgatggaagtaatgaaaactatgcagacgccgtgaagggc

SEQ ID NO: 2852 - DNA, 51 bp, Artificial Sequence; identical to SEQ ID NO: 2847
  source: /note="Description of Artificial Sequence: Synthetic oligonucleotide"

SEQ ID NO: 2853 - DNA, 51 bp, Artificial Sequence; identical to SEQ ID NO: 2847
  source: /note="Description of Artificial Sequence: Synthetic oligonucleotide"

SEQ ID NO: 2854 - DNA, 51 bp, Artificial Sequence; identical to SEQ ID NO: 2828
  source: /note="Description of Artificial Sequence: Synthetic oligonucleotide"

SEQ ID NO: 2855 - DNA, 51 bp, Artificial Sequence; identical to SEQ ID NO: 2847
  source: /note="Description of Artificial Sequence: Synthetic oligonucleotide"

SEQ ID NO: 2856 - DNA, 51 bp, Artificial Sequence; identical to SEQ ID NO: 2847
  source: /note="Description of Artificial Sequence: Synthetic oligonucleotide"

SEQ ID NO: 2857 - DNA, 51 bp, Artificial Sequence; identical to SEQ ID NO: 2847
  source: /note="Description of Artificial Sequence: Synthetic oligonucleotide"

SEQ ID NO: 2858 - DNA, 51 bp, Artificial Sequence; identical to SEQ ID NO: 2847
  source: /note="Description of Artificial Sequence: Synthetic oligonucleotide"

SEQ ID NO: 2859 - DNA, 51 bp, Artificial Sequence; identical to SEQ ID NO: 2847
  source: /note="Description of Artificial Sequence: Synthetic oligonucleotide"

SEQ ID NO: 2860 - DNA, 51 bp, Artificial Sequence; identical to SEQ ID NO: 2847
  source: /note="Description of Artificial Sequence: Synthetic oligonucleotide"

SEQ ID NO: 2861 - DNA, 51 bp, Artificial Sequence; identical to SEQ ID NO: 2847
  source: /note="Description of Artificial Sequence: Synthetic oligonucleotide"

SEQ ID NO: 2862 - DNA, 51 bp, Artificial Sequence; identical to SEQ ID NO: 2851
  source: /note="Description of Artificial Sequence: Synthetic oligonucleotide"

SEQ ID NO: 2863 - DNA, 51 bp, Artificial Sequence; identical to SEQ ID NO: 2850
  source: /note="Description of Artificial Sequence: Synthetic oligonucleotide"

SEQ ID NO: 2864 - DNA, 51 bp, Artificial Sequence; identical to SEQ ID NO: 2847
  source: /note="Description of Artificial Sequence: Synthetic oligonucleotide"

SEQ ID NO: 2865 - DNA, 51 bp, Artificial Sequence; identical to SEQ ID NO: 2847
  source: /note="Description of Artificial Sequence: Synthetic oligonucleotide"

SEQ ID NO: 2866 - DNA, 51 bp, Artificial Sequence; identical to SEQ ID NO: 2841
  source: /note="Description of Artificial Sequence: Synthetic oligonucleotide"

SEQ ID NO: 2867 - DNA, 51 bp, Artificial Sequence; identical to SEQ ID NO: 2841
  source: /note="Description of Artificial Sequence: Synthetic oligonucleotide"

SEQ ID NO: 2868 - DNA, 51 bp, Artificial Sequence; identical to SEQ ID NO: 2841
  source: /note="Description of Artificial Sequence: Synthetic oligonucleotide"

SEQ ID NO: 2869 - DNA, 51 bp, Artificial Sequence; identical to SEQ ID NO: 2841
  source: /note="Description of Artificial Sequence: Synthetic oligonucleotide"

SEQ ID NO: 2870 - DNA, 51 bp, Artificial Sequence; identical to SEQ ID NO: 2841
  source: /note="Description of Artificial Sequence: Synthetic oligonucleotide"

SEQ ID NO: 2871 - DNA, 51 bp, Artificial Sequence; identical to SEQ ID NO: 2841
  source: /note="Description of Artificial Sequence: Synthetic oligonucleotide"

SEQ ID NO: 2872 - DNA, 51 bp, Artificial Sequence; identical to SEQ ID NO: 2841
  source: /note="Description of Artificial Sequence: Synthetic oligonucleotide"

SEQ ID NO: 2873 - DNA, 51 bp, Artificial Sequence; identical to SEQ ID NO: 2842
  source: /note="Description of Artificial Sequence: Synthetic oligonucleotide"

SEQ ID NO: 2874 - DNA, 51 bp, Artificial Sequence; identical to SEQ ID NO: 2843
  source: /note="Description of Artificial Sequence: Synthetic oligonucleotide"

SEQ ID NO: 2875 - DNA, 51 bp, Artificial Sequence; identical to SEQ ID NO: 2841
  source: /note="Description of Artificial Sequence: Synthetic oligonucleotide"

SEQ ID NO: 2876 - DNA, 51 bp, Artificial Sequence; identical to SEQ ID NO: 2841
  source: /note="Description of Artificial Sequence: Synthetic oligonucleotide"

SEQ ID NO: 2877 - DNA, 51 bp, Artificial Sequence; identical to SEQ ID NO: 2841
  source: /note="Description of Artificial Sequence: Synthetic oligonucleotide"

SEQ ID NO: 2878 - DNA, 51 bp, Artificial Sequence; identical to SEQ ID NO: 2841
  source: /note="Description of Artificial Sequence: Synthetic oligonucleotide"

SEQ ID NO: 2879 - DNA, 51 bp, Artificial Sequence; identical to SEQ ID NO: 2829
  source: /note="Description of Artificial Sequence: Synthetic oligonucleotide"

SEQ ID NO: 2880 - DNA, 51 bp, Artificial Sequence; identical to SEQ ID NO: 2842
  source: /note="Description of Artificial Sequence: Synthetic oligonucleotide"

SEQ ID NO: 2881 - DNA, 51 bp, Artificial Sequence; identical to SEQ ID NO: 2843
  source: /note="Description of Artificial Sequence: Synthetic oligonucleotide"

SEQ ID NO: 2882 - DNA, 51 bp, Artificial Sequence
  source: /note="Description of Artificial Sequence: Synthetic oligonucleotide"
gctatatggtatgatgcaaataataaatactatgcagacgccgtgaagggc

SEQ ID NO: 2883 - DNA, 51 bp, Artificial Sequence; identical to SEQ ID NO: 2882
  source: /note="Description of Artificial Sequence: Synthetic oligonucleotide"

SEQ ID NO: 2884 - DNA, 51 bp, Artificial Sequence; identical to SEQ ID NO: 2882
  source: /note="Description of Artificial Sequence: Synthetic oligonucleotide"

SEQ ID NO: 2885 - DNA, 51 bp, Artificial Sequence; identical to SEQ ID NO: 2882
  source: /note="Description of Artificial Sequence: Synthetic oligonucleotide"

SEQ ID NO: 2886 - DNA, 51 bp, Artificial Sequence; identical to SEQ ID NO: 2882
  source: /note="Description of Artificial Sequence: Synthetic oligonucleotide"

SEQ ID NO: 2887 - DNA, 51 bp, Artificial Sequence; identical to SEQ ID NO: 2882
  source: /note="Description of Artificial Sequence: Synthetic oligonucleotide"

SEQ ID NO: 2888 - DNA, 51 bp, Artificial Sequence; identical to SEQ ID NO: 2882
  source: /note="Description of Artificial Sequence: Synthetic oligonucleotide"

SEQ ID NO: 2889 - DNA, 51 bp, Artificial Sequence
  source: /note="Description of Artificial Sequence: Synthetic oligonucleotide"
gctatatggtatgatggaaataataaatactatgcagacgccgtgaagggc

SEQ ID NO: 2890 - DNA, 51 bp, Artificial Sequence
  source: /note="Description of Artificial Sequence: Synthetic oligonucleotide"
gctatatggtatgatgcaaataataaatactatgcagactccgtgaagggc

SEQ ID NO: 2891 - DNA, 51 bp, Artificial Sequence; identical to SEQ ID NO: 2882
  source: /note="Description of Artificial Sequence: Synthetic oligonucleotide"

SEQ ID NO: 2892 - DNA, 51 bp, Artificial Sequence; identical to SEQ ID NO: 2882
  source: /note="Description of Artificial Sequence: Synthetic oligonucleotide"

SEQ ID NO: 2893 - DNA, 51 bp, Artificial Sequence
  source: /note="Description of Artificial Sequence: Synthetic oligonucleotide"
gttatatggtatgatgcaagtaataaatactatgaagacgccgtgaagggc

SEQ ID NO: 2894 - DNA, 51 bp, Artificial Sequence
  source: /note="Description of Artificial Sequence: Synthetic oligonucleotide"
gttatatggtatgatggaagtaataaatactatgaagactccgtgaagggc

SEQ ID NO: 2895 - DNA, 51 bp, Artificial Sequence
  source: /note="Description of Artificial Sequence: Synthetic oligonucleotide"
gttatatggtatgatggaagtaataaatactatgaagacgccgtgaagggc

SEQ ID NO: 2896 - DNA, 51 bp, Artificial Sequence
  source: /note="Description of Artificial Sequence: Synthetic oligonucleotide"
gttatatggtatgatgcaagtaataaatactatgaagactccgtgaagggc

SEQ ID NO: 2897 - DNA, 51 bp, Artificial Sequence
  source: /note="Description of Artificial Sequence: Synthetic oligonucleotide"
gctatatggtttgatgcaagtgataaatactatgcagacgccgtgaagggc

SEQ ID NO: 2898 - DNA, 51 bp, Artificial Sequence
  source: /note="Description of Artificial Sequence: Synthetic oligonucleotide"
gctatatggtttgatgcaagtgataaatactatgcagactccgtgaagggc

SEQ ID NO: 2899 - DNA, 51 bp, Artificial Sequence
  source: /note="Description of Artificial Sequence: Synthetic oligonucleotide"
gctatatggtttgatggaagtgataaatactatgcagacgccgtgaagggc

SEQ ID NO: 2900 - DNA, 51 bp, Artificial Sequence; identical to SEQ ID NO: 2897
  source: /note="Description of Artificial Sequence: Synthetic oligonucleotide"

SEQ ID NO: 2901 - DNA, 51 bp, Artificial Sequence; identical to SEQ ID NO: 2897
  source: /note="Description of Artificial Sequence: Synthetic oligonucleotide"

SEQ ID NO: 2902 - DNA, 51 bp, Artificial Sequence; identical to SEQ ID NO: 2897
  source: /note="Description of Artificial Sequence: Synthetic oligonucleotide"

SEQ ID NO: 2903 - DNA, 51 bp, Artificial Sequence; identical to SEQ ID NO: 2897
  source: /note="Description of Artificial Sequence: Synthetic oligonucleotide"

SEQ ID NO: 2904 - DNA, 51 bp, Artificial Sequence; identical to SEQ ID NO: 2897
  source: /note="Description of Artificial Sequence: Synthetic oligonucleotide"

SEQ ID NO: 2905 - DNA, 48 bp, Artificial Sequence; identical to SEQ ID NO: 2835
  source: /note="Description of Artificial Sequence: Synthetic oligonucleotide"

SEQ ID NO: 2906 - DNA, 48 bp, Artificial Sequence; identical to SEQ ID NO: 2835
  source: /note="Description of Artificial Sequence: Synthetic oligonucleotide"

SEQ ID NO: 2907 - DNA, 48 bp, Artificial Sequence; identical to SEQ ID NO: 2835
  source: /note="Description of Artificial Sequence: Synthetic oligonucleotide"

SEQ ID NO: 2908 - DNA, 48 bp, Artificial Sequence; identical to SEQ ID NO: 2835
  source: /note="Description of Artificial Sequence: Synthetic oligonucleotide"

SEQ ID NO: 2909 - DNA, 48 bp, Artificial Sequence; identical to SEQ ID NO: 2835
  source: /note="Description of Artificial Sequence: Synthetic oligonucleotide"

SEQ ID NO: 2910 - DNA, 48 bp, Artificial Sequence; identical to SEQ ID NO: 2835
  source: /note="Description of Artificial Sequence: Synthetic oligonucleotide"

SEQ ID NO: 2911 - DNA, 48 bp, Artificial Sequence; identical to SEQ ID NO: 2835
  source: /note="Description of Artificial Sequence: Synthetic oligonucleotide"

SEQ ID NO: 2912 - DNA, 51 bp, Artificial Sequence
  source: /note="Description of Artificial Sequence: Synthetic oligonucleotide"
tggatcaaccctgaaagtggtggcacagactattcacagaggtttcagggc

SEQ ID NO: 2913 - DNA, 51 bp, Artificial Sequence; identical to SEQ ID NO: 2912
  source: /note="Description of Artificial Sequence: Synthetic oligonucleotide"

SEQ ID NO: 2914 - DNA, 51 bp, Artificial Sequence
  source: /note="Description of Artificial Sequence: Synthetic oligonucleotide"
tggatcaaccctgacgctggtggcacagactattcacagaggtttcagggc

SEQ ID NO: 2915 - DNA, 51 bp, Artificial Sequence; identical to SEQ ID NO: 2914
  source: /note="Description of Artificial Sequence: Synthetic oligonucleotide"

SEQ ID NO: 2916 - DNA, 51 bp, Artificial Sequence; identical to SEQ ID NO: 2831
  source: /note="Description of Artificial Sequence: Synthetic oligonucleotide"

SEQ ID NO: 2917 - DNA, 51 bp, Artificial Sequence; identical to SEQ ID NO: 2831
  source: /note="Description of Artificial Sequence: Synthetic oligonucleotide"

SEQ ID NO: 2918 - DNA, 51 bp, Artificial Sequence; identical to SEQ ID NO: 2831
  source: /note="Description of Artificial Sequence: Synthetic oligonucleotide"

SEQ ID NO: 2919 - DNA, 51 bp, Artificial Sequence; identical to SEQ ID NO: 2914
  source: /note="Description of Artificial Sequence: Synthetic oligonucleotide"

SEQ ID NO: 2920 - DNA, 51 bp, Artificial Sequence; identical to SEQ ID NO: 2914
  source: /note="Description of Artificial Sequence: Synthetic oligonucleotide"

SEQ ID NO: 2921 - DNA, 51 bp, Artificial Sequence; identical to SEQ ID NO: 2914
  source: /note="Description of Artificial Sequence: Synthetic oligonucleotide"

SEQ ID NO: 2922 - DNA, 51 bp, Artificial Sequence; identical to SEQ ID NO: 2912
  source: /note="Description of Artificial Sequence: Synthetic oligonucleotide"

SEQ ID NO: 2923 - DNA, 51 bp, Artificial Sequence
  source: /note="Description of Artificial Sequence: Synthetic oligonucleotide"
tggatcagccctaacagtggtgaaacaagctatgcacagaagtttcaggac

SEQ ID NO: 2924 - DNA, 51 bp, Artificial Sequence; identical to SEQ ID NO: 2833
  source: /note="Description of Artificial Sequence: Synthetic oligonucleotide"

SEQ ID NO: 2925 - DNA, 51 bp, Artificial Sequence; identical to SEQ ID NO: 2923
  source: /note="Description of Artificial Sequence: Synthetic oligonucleotide"

SEQ ID NO: 2926 - DNA, 51 bp, Artificial Sequence; identical to SEQ ID NO: 2923
  source: /note="Description of Artificial Sequence: Synthetic oligonucleotide"

SEQ ID NO: 2927 - DNA, 51 bp, Artificial Sequence; identical to SEQ ID NO: 2833
  source: /note="Description of Artificial Sequence: Synthetic oligonucleotide"

SEQ ID NO: 2928 - DNA, 51 bp, Artificial Sequence; identical to SEQ ID NO: 2923
  source: /note="Description of Artificial Sequence: Synthetic oligonucleotide"

SEQ ID NO: 2929 - DNA, 51 bp, Artificial Sequence; identical to SEQ ID NO: 2833
  source: /note="Description of Artificial Sequence: Synthetic oligonucleotide"

SEQ ID NO: 2930 - DNA, 51 bp, Artificial Sequence; identical to SEQ ID NO: 2923
  source: /note="Description of Artificial Sequence: Synthetic oligonucleotide"

SEQ ID NO: 2931 - DNA, 51 bp, Artificial Sequence; identical to SEQ ID NO: 2923
  source: /note="Description of Artificial Sequence: Synthetic oligonucleotide"

SEQ ID NO: 2932 - DNA, 51 bp, Artificial Sequence; identical to SEQ ID NO: 2912
  source: /note="Description of Artificial Sequence: Synthetic oligonucleotide"

SEQ ID NO: 2933 - DNA, 51 bp, Artificial Sequence; identical to SEQ ID NO: 2912
  source: /note="Description of Artificial Sequence: Synthetic oligonucleotide"

SEQ ID NO: 2934 - DNA, 51 bp, Artificial Sequence; identical to SEQ ID NO: 2831
  source: /note="Description of Artificial Sequence: Synthetic oligonucleotide"

SEQ ID NO: 2935 - DNA, 51 bp, Artificial Sequence; identical to SEQ ID NO: 2912
  source: /note="Description of Artificial Sequence: Synthetic oligonucleotide"

SEQ ID NO: 2936 - DNA, 51 bp, Artificial Sequence; identical to SEQ ID NO: 2912
  source: /note="Description of Artificial Sequence: Synthetic oligonucleotide"

SEQ ID NO: 2937 - DNA, 51 bp, Artificial Sequence
  source: /note="Description of Artificial Sequence: Synthetic oligonucleotide"
tggataagccctaaccaaggtgaaacaaactatgcacagaagtttcaggac

SEQ ID NO: 2938 - DNA, 51 bp, Artificial Sequence
  source: /note="Description of Artificial Sequence: Synthetic oligonucleotide"
tggataagccctaaccaaggtgacacaaactatgcacagaagtttcaggac

SEQ ID NO: 2939 - DNA, 51 bp, Artificial Sequence; identical to SEQ ID NO: 2937
  source: /note="Description of Artificial Sequence: Synthetic oligonucleotide"

SEQ ID NO: 2940 - DNA, 51 bp, Artificial Sequence
  source: /note="Description of Artificial Sequence: Synthetic oligonucleotide"
tggataagccctaacaatggtgaaacaaactatgcacagaagtttcaggac

SEQ ID NO: 2941 - DNA, 51 bp, Artificial Sequence; identical to SEQ ID NO: 2834
  source: /note="Description of Artificial Sequence: Synthetic oligonucleotide"

SEQ ID NO: 2942 - DNA, 51 bp, Artificial Sequence; identical to SEQ ID NO: 2938
  source: /note="Description of Artificial Sequence: Synthetic oligonucleotide"

SEQ ID NO: 2943 - DNA, 51 bp, Artificial Sequence; identical to SEQ ID NO: 2940
  source: /note="Description of Artificial Sequence: Synthetic oligonucleotide"

SEQ ID NO: 2944 - DNA, 51 bp, Artificial Sequence; identical to SEQ ID NO: 2937
  source: /note="Description of Artificial Sequence: Synthetic oligonucleotide"

SEQ ID NO: 2945 - DNA, 51 bp, Artificial Sequence; identical to SEQ ID NO: 2834
  source: /note="Description of Artificial Sequence: Synthetic oligonucleotide"

SEQ ID NO: 2946 - DNA, 51 bp, Artificial Sequence; identical to SEQ ID NO: 2938
  source: /note="Description of Artificial Sequence: Synthetic oligonucleotide"

SEQ ID NO: 2947 - DNA, 51 bp, Artificial Sequence; identical to SEQ ID NO: 2940
  source: /note="Description of Artificial Sequence: Synthetic oligonucleotide"

SEQ ID NO: 2948 - DNA, 51 bp, Artificial Sequence; identical to SEQ ID NO: 2937
  source: /note="Description of Artificial Sequence: Synthetic oligonucleotide"

SEQ ID NO: 2949 - DNA, 51 bp, Artificial Sequence; identical to SEQ ID NO: 2937
  source: /note="Description of Artificial Sequence: Synthetic oligonucleotide"

SEQ ID NO: 2950 - DNA, 51 bp, Artificial Sequence; identical to SEQ ID NO: 2827
  source: /note="Description of Artificial Sequence: Synthetic oligonucleotide"

SEQ ID NO: 2951 - DNA, 51 bp, Artificial Sequence; identical to SEQ ID NO: 2827
  source: /note="Description of Artificial Sequence: Synthetic oligonucleotide"

SEQ ID NO: 2952 - DNA, 51 bp, Artificial Sequence; identical to SEQ ID NO: 2827
  source: /note="Description of Artificial Sequence: Synthetic oligonucleotide"

SEQ ID NO: 2953 - DNA, 51 bp, Artificial Sequence; identical to SEQ ID NO: 2827
  source: /note="Description of Artificial Sequence: Synthetic oligonucleotide"

SEQ ID NO: 2954 - DNA, 51 bp, Artificial Sequence; identical to SEQ ID NO: 2827
  source: /note="Description of Artificial Sequence: Synthetic oligonucleotide"

SEQ ID NO: 2955 - DNA, 51 bp, Artificial Sequence; identical to SEQ ID NO: 2827
  source: /note="Description of Artificial Sequence: Synthetic oligonucleotide"

SEQ ID NO: 2956 - DNA, 51 bp, Artificial Sequence; identical to SEQ ID NO: 2827
  source: /note="Description of Artificial Sequence: Synthetic oligonucleotide"

SEQ ID NO: 2957 - DNA, 51 bp, Artificial Sequence; identical to SEQ ID NO: 2827
  source: /note="Description of Artificial Sequence: Synthetic oligonucleotide"

SEQ ID NO: 2958 - DNA, 51 bp, Artificial Sequence; identical to SEQ ID NO: 2827
  source: /note="Description of Artificial Sequence: Synthetic oligonucleotide"

SEQ ID NO: 2959 - DNA, 51 bp, Artificial Sequence; identical to SEQ ID NO: 2827
  source: /note="Description of Artificial Sequence: Synthetic oligonucleotide"

SEQ ID NO: 2960 - DNA, 51 bp, Artificial Sequence; identical to SEQ ID NO: 2827
  source: /note="Description of Artificial Sequence: Synthetic oligonucleotide"

SEQ ID NO: 2961 - DNA, 51 bp, Artificial Sequence; identical to SEQ ID NO: 2827
  source: /note="Description of Artificial Sequence: Synthetic oligonucleotide"

SEQ ID NO: 2962 - DNA, 51 bp, Artificial Sequence; identical to SEQ ID NO: 2827
  source: /note="Description of Artificial Sequence: Synthetic oligonucleotide"

SEQ ID NO: 2963 - DNA, 51 bp, Artificial Sequence; identical to SEQ ID NO: 2827
  source: /note="Description of Artificial Sequence: Synthetic oligonucleotide"

SEQ ID NO: 2964 - DNA, 51 bp, Artificial Sequence; identical to SEQ ID NO: 2847
  source: /note="Description of Artificial Sequence: Synthetic oligonucleotide"

SEQ ID NO: 2965 - DNA, 51 bp, Artificial Sequence; identical to SEQ ID NO: 2841
  source: /note="Description of Artificial Sequence: Synthetic oligonucleotide"

SEQ ID NO: 2966 - DNA, 51 bp, Artificial Sequence; identical to SEQ ID NO: 2827
  source: /note="Description of Artificial Sequence: Synthetic oligonucleotide"

SEQ ID NO: 2967 - DNA, 51 bp, Artificial Sequence
  source: /note="Description of Artificial Sequence: Synthetic oligonucleotide"
gttatatggtatgatggaagtaataagttccatgcagactccgtgaagggc

SEQ ID NO: 2968 - DNA, 51 bp, Artificial Sequence
  source: /note="Description of Artificial Sequence: Synthetic oligonucleotide"
tggatgaaccctaacagtggtaacacaggctatgcacagaagttccagggc

SEQ ID NO: 2969 - DNA, 51 bp, Artificial Sequence
  source: /note="Description of Artificial Sequence: Synthetic oligonucleotide"
gttatatggtatgatgcaagtaataagttccatgcagacgccgtgaagggc

SEQ ID NO: 2970 - DNA, 51 bp, Artificial Sequence; identical to SEQ ID NO: 2969
  source: /note="Description of Artificial Sequence: Synthetic oligonucleotide"

SEQ ID NO: 2971 - DNA, 51 bp, Artificial Sequence; identical to SEQ ID NO: 2969
  source: /note="Description of Artificial Sequence: Synthetic oligonucleotide"

SEQ ID NO: 2972 - DNA, 51 bp, Artificial Sequence; identical to SEQ ID NO: 2969
  source: /note="Description of Artificial Sequence: Synthetic oligonucleotide"

SEQ ID NO: 2973 - DNA, 51 bp, Artificial Sequence
  source: /note="Description of Artificial Sequence: Synthetic oligonucleotide"
gttatatggtatgatgcaagtaataagttccatgcagactccgtgaagggc

SEQ ID NO: 2974 - DNA, 51 bp, Artificial Sequence
  source: /note="Description of Artificial Sequence: Synthetic oligonucleotide"
gttatatggtatgatggaagtaataagttccatgcagacgccgtgaagggc

SEQ ID NO: 2975 - DNA, 51 bp, Artificial Sequence
  source: /note="Description of Artificial Sequence: Synthetic oligonucleotide"
tggatgaaccctaacagtggtggcacaggctatgcacagaagttccagggc

SEQ ID NO: 2976 - DNA, 51 bp, Artificial Sequence; identical to SEQ ID NO: 2968
  source: /note="Description of Artificial Sequence: Synthetic oligonucleotide"

SEQ ID NO: 2977 - DNA, 51 bp, Artificial Sequence; identical to SEQ ID NO: 2975
  source: /note="Description of Artificial Sequence: Synthetic oligonucleotide"

SEQ ID NO: 2978 - DNA, 51 bp, Artificial Sequence; identical to SEQ ID NO: 2975
  source: /note="Description of Artificial Sequence: Synthetic oligonucleotide"

SEQ ID NO: 2979 - DNA, 51 bp, Artificial Sequence; identical to SEQ ID NO: 2975
  source: /note="Description of Artificial Sequence: Synthetic oligonucleotide"

SEQ ID NO: 2980 - DNA, 51 bp, Artificial Sequence; identical to SEQ ID NO: 2968
  source: /note="Description of Artificial Sequence: Synthetic oligonucleotide"

SEQ ID NO: 2981 - DNA, 51 bp, Artificial Sequence; identical to SEQ ID NO: 2975
  source: /note="Description of Artificial Sequence: Synthetic oligonucleotide"

SEQ ID NO: 2982 - DNA, 51 bp, Artificial Sequence; identical to SEQ ID NO: 2975
  source: /note="Description of Artificial Sequence: Synthetic oligonucleotide"

SEQ ID NO: 2983 - DNA, 51 bp, Artificial Sequence; identical to SEQ ID NO: 2969
  source: /note="Description of Artificial Sequence: Synthetic oligonucleotide"

SEQ ID NO: 2984 - DNA, 57 bp, Artificial Sequence
  source: /note="Description of Artificial Sequence: Synthetic oligonucleotide"
gggggggattacgtttgggggacttatcggcctcactactactacggtatggacgtc

SEQ ID NO: 2985 - DNA, 36 bp, Artificial Sequence
  source: /note="Description of Artificial Sequence: Synthetic oligonucleotide"
gatgggacgatctttggagtggtcttgggggactac

SEQ ID NO: 2986 - DNA, 36 bp, Artificial Sequence
  source: /note="Description of Artificial Sequence: Synthetic oligonucleotide"
gatgggacgatttttggagtgctcttgggggactac

SEQ ID NO: 2987 - DNA, 33 bp, Artificial Sequence
  source: /note="Description of Artificial Sequence: Synthetic oligonucleotide"
gataggacgatttttggagtggttcttgactac

SEQ ID NO: 2988 - DNA, 42 bp, Artificial Sequence
  source: /note="Description of Artificial Sequence: Synthetic oligonucleotide"
gaggccacgatttttggaatggttattgtaccgtttgactac

SEQ ID NO: 2989 - DNA, 42 bp, Artificial Sequence; identical to SEQ ID NO: 2988
  source: /note="Description of Artificial Sequence: Synthetic oligonucleotide"

SEQ ID NO: 2990 - DNA, 42 bp, Artificial Sequence
  source: /note="Description of Artificial Sequence: Synthetic oligonucleotide"
gaggccacgatttttggaatgcttattgtaccatttgactac

SEQ ID NO: 2991 - DNA, 42 bp, Artificial Sequence; identical to SEQ ID NO: 2990
  source: /note="Description of Artificial Sequence: Synthetic oligonucleotide"

SEQ ID NO: 2992 - DNA, 48 bp, Artificial Sequence
  source: /note="Description of Artificial Sequence: Synthetic oligonucleotide"
gatcgtattacgatttttggagtggttatggggggcggtatggacgtc

SEQ ID NO: 2993 - DNA, 33 bp, Artificial Sequence
  source: /note="Description of Artificial Sequence: Synthetic oligonucleotide"
gatcaggcgatttttggagtggtccccgactac

SEQ ID NO: 2994 - DNA, 36 bp, Artificial Sequence; identical to SEQ ID NO: 2986
  source: /note="Description of Artificial Sequence: Synthetic oligonucleotide"

SEQ ID NO: 2995 - DNA, 33 bp, Artificial Sequence
  source: /note="Description of Artificial Sequence: Synthetic oligonucleotide"
gatcggacgatttttggagtggtccttgagtac

SEQ ID NO: 2996 - DNA, 27 bp, Artificial Sequence
  source: /note="Description of Artificial Sequence: Synthetic oligonucleotide"
gatgtagcagtggctggctttgactac

SEQ ID NO: 2997 - DNA, 27 bp, Artificial Sequence
  source: /note="Description of Artificial Sequence: Synthetic oligonucleotide"
gatgtagcagtggctggctttgactac

SEQ ID NO: 2998 - DNA, 36 bp, Artificial Sequence; identical to SEQ ID NO: 2986
  source: /note="Description of Artificial Sequence: Synthetic oligonucleotide"

SEQ ID NO: 2999 - DNA, 36 bp, Artificial Sequence; identical to SEQ ID NO: 2986
  source: /note="Description of Artificial Sequence: Synthetic oligonucleotide"

SEQ ID NO: 3000 - DNA, 36 bp, Artificial Sequence; identical to SEQ ID NO: 2986
  source: /note="Description of Artificial Sequence: Synthetic oligonucleotide"

SEQ ID NO: 3001 - DNA, 36 bp, Artificial Sequence; identical to SEQ ID NO: 2986
  source: /note="Description of Artificial Sequence: Synthetic oligonucleotide"

SEQ ID NO: 3002 - DNA, 36 bp, Artificial Sequence; identical to SEQ ID NO: 2986
  source: /note="Description of Artificial Sequence: Synthetic oligonucleotide"

SEQ ID NO: 3003 - DNA, 36 bp, Artificial Sequence
  source: /note="Description of Artificial Sequence: Synthetic oligonucleotide"
gataggacgatttttggagtgctcttgggggactac

SEQ ID NO: 3004 - DNA, 36 bp, Artificial Sequence; identical to SEQ ID NO: 2985
  source: /note="Description of Artificial Sequence: Synthetic oligonucleotide"

SEQ ID NO: 3005 - DNA, 36 bp, Artificial Sequence; identical to SEQ ID NO: 2985
  source: /note="Description of Artificial Sequence: Synthetic oligonucleotide"

SEQ ID NO: 3006 - DNA, 36 bp, Artificial Sequence; identical to SEQ ID NO: 2985
  source: /note="Description of Artificial Sequence: Synthetic oligonucleotide"

SEQ ID NO: 3007 - DNA, 36 bp, Artificial Sequence; identical to SEQ ID NO: 2985
  source: /note="Description of Artificial Sequence: Synthetic oligonucleotide"

SEQ ID NO: 3008 - DNA, 36 bp, Artificial Sequence; identical to SEQ ID NO: 2985
  source: /note="Description of Artificial Sequence: Synthetic oligonucleotide"

SEQ ID NO: 3009 - DNA, 36 bp, Artificial Sequence
  source: /note="Description of Artificial Sequence: Synthetic oligonucleotide"
gataggacgatctttggagtggtcttgggggactac

SEQ ID NO: 3010 - DNA, 36 bp, Artificial Sequence; identical to SEQ ID NO: 2985
  source: /note="Description of Artificial Sequence: Synthetic oligonucleotide"

SEQ ID NO: 3011 - DNA, 36 bp, Artificial Sequence; identical to SEQ ID NO: 2985
  source: /note="Description of Artificial Sequence: Synthetic oligonucleotide"

SEQ ID NO: 3012 - DNA, 36 bp, Artificial Sequence; identical to SEQ ID NO: 2985
  source: /note="Description of Artificial Sequence: Synthetic oligonucleotide"

SEQ ID NO: 3013 - DNA, 36 bp, Artificial Sequence; identical to SEQ ID NO: 2985
  source: /note="Description of Artificial Sequence: Synthetic oligonucleotide"

SEQ ID NO: 3014 - DNA, 36 bp, Artificial Sequence; identical to SEQ ID NO: 2985
  source: /note="Description of Artificial Sequence: Synthetic oligonucleotide"

SEQ ID NO: 3015 - DNA, 36 bp, Artificial Sequence; identical to SEQ ID NO: 2985
  source: /note="Description of Artificial Sequence: Synthetic oligonucleotide"

SEQ ID NO: 3016 - DNA, 36 bp, Artificial Sequence; identical to SEQ ID NO: 2985
  source: /note="Description of Artificial Sequence: Synthetic oligonucleotide"

SEQ ID NO: 3017 - DNA, 36 bp, Artificial Sequence; identical to SEQ ID NO: 2985
  source: /note="Description of Artificial Sequence: Synthetic oligonucleotide"

SEQ ID NO: 3018 - DNA, 36 bp, Artificial Sequence; identical to SEQ ID NO: 2985
  source: /note="Description of Artificial Sequence: Synthetic oligonucleotide"

SEQ ID NO: 3019 - DNA, 36 bp, Artificial Sequence; identical to SEQ ID NO: 2985
  source: /note="Description of Artificial Sequence: Synthetic oligonucleotide"

SEQ ID NO: 3020 - DNA, 36 bp, Artificial Sequence; identical to SEQ ID NO: 2985
  source: /note="Description of Artificial Sequence: Synthetic oligonucleotide"

SEQ ID NO: 3021 - DNA, 36 bp, Artificial Sequence; identical to SEQ ID NO: 3009
  source: /note="Description of Artificial Sequence: Synthetic oligonucleotide"

SEQ ID NO: 3022 - DNA, 36 bp, Artificial Sequence; identical to SEQ ID NO: 2985
  source: /note="Description of Artificial Sequence: Synthetic oligonucleotide"

SEQ ID NO: 3023 - DNA, 33 bp, Artificial Sequence; identical to SEQ ID NO: 2987
  source: /note="Description of Artificial Sequence: Synthetic oligonucleotide"

SEQ ID NO: 3024 - DNA, 33 bp, Artificial Sequence; identical to SEQ ID NO: 2987
  source: /note="Description of Artificial Sequence: Synthetic oligonucleotide"

SEQ ID NO: 3025 - DNA, 33 bp, Artificial Sequence; identical to SEQ ID NO: 2987
  source: /note="Description of Artificial Sequence: Synthetic oligonucleotide"

SEQ ID NO: 3026 - DNA, 33 bp, Artificial Sequence; identical to SEQ ID NO: 2987
  source: /note="Description of Artificial Sequence: Synthetic oligonucleotide"

SEQ ID NO: 3027 - DNA, 33 bp, Artificial Sequence; identical to SEQ ID NO: 2987
  source: /note="Description of Artificial Sequence: Synthetic oligonucleotide"

SEQ ID NO: 3028 - DNA, 33 bp, Artificial Sequence; identical to SEQ ID NO: 2987
  source: /note="Description of Artificial Sequence: Synthetic oligonucleotide"

SEQ ID NO: 3029 - DNA, 33 bp, Artificial Sequence; identical to SEQ ID NO: 2987
  source: /note="Description of Artificial Sequence: Synthetic oligonucleotide"

SEQ ID NO: 3030 - DNA, 33 bp, Artificial Sequence; identical to SEQ ID NO: 2987
  source: /note="Description of Artificial Sequence: Synthetic oligonucleotide"

SEQ ID NO: 3031 - DNA, 33 bp, Artificial Sequence; identical to SEQ ID NO: 2987
  source: /note="Description of Artificial Sequence: Synthetic oligonucleotide"

SEQ ID NO: 3032 - DNA, 36 bp, Artificial Sequence; identical to SEQ ID NO: 2986
  source: /note="Description of Artificial Sequence: Synthetic oligonucleotide"

SEQ ID NO: 3033 - DNA, 36 bp, Artificial Sequence; identical to SEQ ID NO: 3003
  source: /note="Description of Artificial Sequence: Synthetic oligonucleotide"

SEQ ID NO: 3034 - DNA, 36 bp, Artificial Sequence; identical to SEQ ID NO: 2986
  source: /note="Description of Artificial Sequence: Synthetic oligonucleotide"

SEQ ID NO: 3035 - DNA, 36 bp, Artificial Sequence; identical to SEQ ID NO: 3003
  source: /note="Description of Artificial Sequence: Synthetic oligonucleotide"

SEQ ID NO: 3036 - DNA, 36 bp, Artificial Sequence; identical to SEQ ID NO: 2986
  source: /note="Description of Artificial Sequence: Synthetic oligonucleotide"

SEQ ID NO: 3037 - DNA, 36 bp, Artificial Sequence; identical to SEQ ID NO: 2986
  source: /note="Description of Artificial Sequence: Synthetic oligonucleotide"

SEQ ID NO: 3038 - DNA, 36 bp, Artificial Sequence; identical to SEQ ID NO: 2986
  source: /note="Description of Artificial Sequence: Synthetic oligonucleotide"

SEQ ID NO: 3039 - DNA, 33 bp, Artificial Sequence; identical to SEQ ID NO: 2995
  source: /note="Description of Artificial Sequence: Synthetic oligonucleotide"

SEQ ID NO: 3040 - DNA, 33 bp, Artificial Sequence; identical to SEQ ID NO: 2995
  source: /note="Description of Artificial Sequence: Synthetic oligonucleotide"

SEQ ID NO: 3041 - DNA, 33 bp, Artificial Sequence; identical to SEQ ID NO: 2995
  source: /note="Description of Artificial Sequence: Synthetic oligonucleotide"

SEQ ID NO: 3042 - DNA, 33 bp, Artificial Sequence; identical to SEQ ID NO: 2995
  source: /note="Description of Artificial Sequence: Synthetic oligonucleotide"

SEQ ID NO: 3043 - DNA, 33 bp, Artificial Sequence; identical to SEQ ID NO: 2995
  source: /note="Description of Artificial Sequence: Synthetic oligonucleotide"

SEQ ID NO: 3044 - DNA, 33 bp, Artificial Sequence; identical to SEQ ID NO: 2995
  source: /note="Description of Artificial Sequence: Synthetic oligonucleotide"

SEQ ID NO: 3045 - DNA, 33 bp, Artificial Sequence; identical to SEQ ID NO: 2995
  source: /note="Description of Artificial Sequence: Synthetic oligonucleotide"

SEQ ID NO: 3046 - DNA, 33 bp, Artificial Sequence; identical to SEQ ID NO: 2995
  source: /note="Description of Artificial Sequence: Synthetic oligonucleotide"

SEQ ID NO: 3047 - DNA, 33 bp, Artificial Sequence; identical to SEQ ID NO: 2995
  source: /note="Description of Artificial Sequence: Synthetic oligonucleotide"

SEQ ID NO: 3048 - DNA, 33 bp, Artificial Sequence; identical to SEQ ID NO: 2995
  source: /note="Description of Artificial Sequence: Synthetic oligonucleotide"

SEQ ID NO: 3049 - DNA, 33 bp, Artificial Sequence; identical to SEQ ID NO: 2995
  source: /note="Description of Artificial Sequence: Synthetic oligonucleotide"

SEQ ID NO: 3050 - DNA, 33 bp, Artificial Sequence
  source: /note="Description of Artificial Sequence: Synthetic oligonucleotide"
gggattacgatttttggtcatgggtttgaatat

SEQ ID NO: 3051 - DNA, 33 bp, Artificial Sequence; identical to SEQ ID NO: 3050
  source: /note="Description of Artificial Sequence: Synthetic oligonucleotide"

SEQ ID NO: 3052 - DNA, 33 bp, Artificial Sequence; identical to SEQ ID NO: 3050
  source: /note="Description of Artificial Sequence: Synthetic oligonucleotide"

SEQ ID NO: 3053 - DNA, 33 bp, Artificial Sequence; identical to SEQ ID NO: 3050
  source: /note="Description of Artificial Sequence: Synthetic oligonucleotide"

SEQ ID NO: 3054 - DNA, 33 bp, Artificial Sequence; identical to SEQ ID NO: 2993
  source: /note="Description of Artificial Sequence: Synthetic oligonucleotide"

SEQ ID NO: 3055 - DNA, 33 bp, Artificial Sequence; identical to SEQ ID NO: 2993
  source: /note="Description of Artificial Sequence: Synthetic oligonucleotide"

SEQ ID NO: 3056 - DNA, 33 bp, Artificial Sequence; identical to SEQ ID NO: 2993
  source: /note="Description of Artificial Sequence: Synthetic oligonucleotide"

SEQ ID NO: 3057 - DNA, 33 bp, Artificial Sequence; identical to SEQ ID NO: 2993
  source: /note="Description of Artificial Sequence: Synthetic oligonucleotide"

SEQ ID NO: 3058 - DNA, 33 bp, Artificial Sequence; identical to SEQ ID NO: 2993
  source: /note="Description of Artificial Sequence: Synthetic oligonucleotide"

SEQ ID NO: 3059 - DNA, 33 bp, Artificial Sequence; identical to SEQ ID NO: 2993
  source: /note="Description of Artificial Sequence: Synthetic oligonucleotide"

SEQ ID NO: 3060 - DNA, 33 bp, Artificial Sequence; identical to SEQ ID NO: 2993
  source: /note="Description of Artificial Sequence: Synthetic oligonucleotide"

SEQ ID NO: 3061 - DNA, 33 bp, Artificial Sequence; identical to SEQ ID NO: 2993
  source: /note="Description of Artificial Sequence: Synthetic oligonucleotide"

SEQ ID NO: 3062 - DNA, 48 bp, Artificial Sequence; identical to SEQ ID NO: 2992
  source: /note="Description of Artificial Sequence: Synthetic oligonucleotide"

SEQ ID NO: 3063 - DNA, 48 bp, Artificial Sequence; identical to SEQ ID NO: 2992
  source: /note="Description of Artificial Sequence: Synthetic oligonucleotide"

SEQ ID NO: 3064 - DNA, 48 bp, Artificial Sequence; identical to SEQ ID NO: 2992
  source: /note="Description of Artificial Sequence: Synthetic oligonucleotide"

SEQ ID NO: 3065 - DNA, 48 bp, Artificial Sequence; identical to SEQ ID NO: 2992
  source: /note="Description of Artificial Sequence: Synthetic oligonucleotide"

SEQ ID NO: 3066 - DNA, 48 bp, Artificial Sequence; identical to SEQ ID NO: 2992
  source: /note="Description of Artificial Sequence: Synthetic oligonucleotide"

SEQ ID NO: 3067 - DNA, 48 bp, Artificial Sequence; identical to SEQ ID NO: 2992
  source: /note="Description of Artificial Sequence: Synthetic oligonucleotide"

SEQ ID NO: 3068 - DNA, 48 bp, Artificial Sequence; identical to SEQ ID NO: 2992
  source: /note="Description of Artificial Sequence: Synthetic oligonucleotide"

SEQ ID NO: 3069 - DNA, 42 bp, Artificial Sequence; identical to SEQ ID NO: 2988
  source: /note="Description of Artificial Sequence: Synthetic oligonucleotide"

SEQ ID NO: 3070 - DNA, 42 bp, Artificial Sequence; identical to SEQ ID NO: 2988
  source: /note="Description of Artificial Sequence: Synthetic oligonucleotide"

SEQ ID NO: 3071 - DNA, 42 bp, Artificial Sequence; identical to SEQ ID NO: 2988
  source: /note="Description of Artificial Sequence: Synthetic oligonucleotide"

SEQ ID NO: 3072 - DNA, 42 bp, Artificial Sequence; identical to SEQ ID NO: 2988
  source: /note="Description of Artificial Sequence: Synthetic oligonucleotide"

SEQ ID NO: 3073 - DNA, 42 bp, Artificial Sequence; identical to SEQ ID NO: 2988
  source: /note="Description of Artificial Sequence: Synthetic oligonucleotide"

SEQ ID NO: 3074 - DNA, 42 bp, Artificial Sequence; identical to SEQ ID NO: 2988
  source: /note="Description of Artificial Sequence: Synthetic oligonucleotide"

SEQ ID NO: 3075 - DNA, 42 bp, Artificial Sequence; identical to SEQ ID NO: 2988
  source: /note="Description of Artificial Sequence: Synthetic oligonucleotide"

SEQ ID NO: 3076 - DNA, 42 bp, Artificial Sequence; identical to SEQ ID NO: 2988
  source: /note="Description of Artificial Sequence: Synthetic oligonucleotide"

SEQ ID NO: 3077 - DNA, 42 bp, Artificial Sequence; identical to SEQ ID NO: 2988
  source: /note="Description of Artificial Sequence: Synthetic oligonucleotide"

SEQ ID NO: 3078 - DNA, 42 bp, Artificial Sequence; identical to SEQ ID NO: 2988
  source: /note="Description of Artificial Sequence: Synthetic oligonucleotide"

SEQ ID NO: 3079 - DNA, 42 bp, Artificial Sequence; identical to SEQ ID NO: 2988
  source: /note="Description of Artificial Sequence: Synthetic oligonucleotide"

SEQ ID NO: 3080 - DNA, 42 bp, Artificial Sequence; identical to SEQ ID NO: 2990
  source: /note="Description of Artificial Sequence: Synthetic oligonucleotide"

SEQ ID NO: 3081 - DNA, 42 bp, Artificial Sequence; identical to SEQ ID NO: 2990
  source: /note="Description of Artificial Sequence: Synthetic oligonucleotide"

SEQ ID NO: 3082 - DNA, 42 bp, Artificial Sequence; identical to SEQ ID NO: 2990
  source: /note="Description of Artificial Sequence: Synthetic oligonucleotide"

SEQ ID NO: 3083 - DNA, 42 bp, Artificial Sequence; identical to SEQ ID NO: 2990
  source: /note="Description of Artificial Sequence: Synthetic oligonucleotide"

SEQ ID NO: 3084 - DNA, 42 bp, Artificial Sequence; identical to SEQ ID NO: 2990
  source: /note="Description of Artificial Sequence: Synthetic oligonucleotide"

SEQ ID NO: 3085 - DNA, 42 bp, Artificial Sequence; identical to SEQ ID NO: 2990
  source: /note="Description of Artificial Sequence: Synthetic oligonucleotide"

SEQ ID NO: 3086 - DNA, 42 bp, Artificial Sequence; identical to SEQ ID NO: 2990
  source: /note="Description of Artificial Sequence: Synthetic oligonucleotide"

SEQ ID NO: 3087 - DNA, 42 bp, Artificial Sequence; identical to SEQ ID NO: 2990
  source: /note="Description of Artificial Sequence: Synthetic oligonucleotide"

SEQ ID NO: 3088 - DNA, 42 bp, Artificial Sequence; identical to SEQ ID NO: 2990
  source: /note="Description of Artificial Sequence: Synthetic oligonucleotide"

SEQ ID NO: 3089 - DNA, 42 bp, Artificial Sequence; identical to SEQ ID NO: 2988
  source: /note="Description of Artificial Sequence: Synthetic oligonucleotide"

SEQ ID NO: 3090 - DNA, 42 bp, Artificial Sequence; identical to SEQ ID NO: 2988
  source: /note="Description of Artificial Sequence: Synthetic oligonucleotide"

SEQ ID NO: 3091 - DNA, 42 bp, Artificial Sequence; identical to SEQ ID NO: 2988
  source: /note="Description of Artificial Sequence: Synthetic oligonucleotide"

SEQ ID NO: 3092 - DNA, 42 bp, Artificial Sequence; identical to SEQ ID NO: 2988
  source: /note="Description of Artificial Sequence: Synthetic oligonucleotide"

SEQ ID NO: 3093 - DNA, 42 bp, Artificial Sequence; identical to SEQ ID NO: 2988
  source: /note="Description of Artificial Sequence: Synthetic oligonucleotide"

SEQ ID NO: 3094 - DNA, 42 bp, Artificial Sequence; identical to SEQ ID NO: 2990
  source: /note="Description of Artificial Sequence: Synthetic oligonucleotide"

SEQ ID NO: 3095 - DNA, 42 bp, Artificial Sequence; identical to SEQ ID NO: 2990
  source: /note="Description of Artificial Sequence: Synthetic oligonucleotide"

SEQ ID NO: 3096 - DNA, 42 bp, Artificial Sequence; identical to SEQ ID NO: 2990
  source: /note="Description of Artificial Sequence: Synthetic oligonucleotide"

SEQ ID NO: 3097 - DNA, 42 bp, Artificial Sequence; identical to SEQ ID NO: 2990
  source: /note="Description of Artificial Sequence: Synthetic oligonucleotide"

SEQ ID NO: 3098 - DNA, 42 bp, Artificial Sequence; identical to SEQ ID NO: 2990
  source: /note="Description of Artificial Sequence: Synthetic oligonucleotide"

SEQ ID NO: 3099 - DNA, 42 bp, Artificial Sequence; identical to SEQ ID NO: 2990
  source: /note="Description of Artificial Sequence: Synthetic oligonucleotide"

SEQ ID NO: 3100 - DNA, 42 bp, Artificial Sequence; identical to SEQ ID NO: 2990
  source: /note="Description of Artificial Sequence: Synthetic oligonucleotide"

SEQ ID NO: 3101 - DNA, 42 bp, Artificial Sequence; identical to SEQ ID NO: 2990
  source: /note="Description of Artificial Sequence: Synthetic oligonucleotide"

SEQ ID NO: 3102 - DNA, 42 bp, Artificial Sequence; identical to SEQ ID NO: 2990
  source: /note="Description of Artificial Sequence: Synthetic oligonucleotide"

SEQ ID NO: 3103 - DNA, 42 bp, Artificial Sequence; identical to SEQ ID NO: 2990
  source: /note="Description of Artificial Sequence: Synthetic oligonucleotide"

SEQ ID NO: 3104 - DNA, 42 bp, Artificial Sequence; identical to SEQ ID NO: 2990
  source: /note="Description of Artificial Sequence: Synthetic oligonucleotide"

SEQ ID NO: 3105 - DNA, 42 bp, Artificial Sequence; identical to SEQ ID NO: 2990
  source: /note="Description of Artificial Sequence: Synthetic oligonucleotide"

SEQ ID NO: 3106 - DNA, 42 bp, Artificial Sequence; identical to SEQ ID NO: 2990
  source: /note="Description of Artificial Sequence: Synthetic oligonucleotide"

SEQ ID NO: 3107 - DNA, 57 bp, Artificial Sequence; identical to SEQ ID NO: 2984
  source: /note="Description of Artificial Sequence: Synthetic oligonucleotide"

SEQ ID NO: 3108 - DNA, 57 bp, Artificial Sequence; identical to SEQ ID NO: 2984
  source: /note="Description of Artificial Sequence: Synthetic oligonucleotide"

SEQ ID NO: 3109 - DNA, 57 bp, Artificial Sequence; identical to SEQ ID NO: 2984
  source: /note="Description of Artificial Sequence: Synthetic oligonucleotide"

SEQ ID NO: 3110 - DNA, 57 bp, Artificial Sequence; identical to SEQ ID NO: 2984
  source: /note="Description of Artificial Sequence: Synthetic oligonucleotide"

SEQ ID NO: 3111 - DNA, 57 bp, Artificial Sequence; identical to SEQ ID NO: 2984
  source: /note="Description of Artificial Sequence: Synthetic oligonucleotide"

SEQ ID NO: 3112 - DNA, 57 bp, Artificial Sequence; identical to SEQ ID NO: 2984
  source: /note="Description of Artificial Sequence: Synthetic oligonucleotide"

SEQ ID NO: 3113 - DNA, 57 bp, Artificial Sequence; identical to SEQ ID NO: 2984
  source: /note="Description of Artificial Sequence: Synthetic oligonucleotide"

SEQ ID NO: 3114 - DNA, 57 bp, Artificial Sequence; identical to SEQ ID NO: 2984
  source: /note="Description of Artificial Sequence: Synthetic oligonucleotide"

SEQ ID NO: 3115 - DNA, 57 bp, Artificial Sequence; identical to SEQ ID NO: 2984
  source: /note="Description of Artificial Sequence: Synthetic oligonucleotide"

SEQ ID NO: 3116 - DNA, 57 bp, Artificial Sequence; identical to SEQ ID NO: 2984
  source: /note="Description of Artificial Sequence: Synthetic oligonucleotide"

SEQ ID NO: 3117 - DNA, 57 bp, Artificial Sequence; identical to SEQ ID NO: 2984
  source: /note="Description of Artificial Sequence: Synthetic oligonucleotide"

SEQ ID NO: 3118 - DNA, 57 bp, Artificial Sequence; identical to SEQ ID NO: 2984
  source: /note="Description of Artificial Sequence: Synthetic oligonucleotide"

SEQ ID NO: 3119 - DNA, 57 bp, Artificial Sequence
  source: /note="Description of Artificial Sequence: Synthetic oligonucleotide"
gggggggattacgttttcgggacttatcggcctcactactactacggtatggacgtc

SEQ ID NO: 3120 - DNA, 57 bp, Artificial Sequence; identical to SEQ ID NO: 3119
  source: /note="Description of Artificial Sequence: Synthetic oligonucleotide"

SEQ ID NO: 3121 - DNA, 36 bp, Artificial Sequence; identical to SEQ ID NO: 3009
  source: /note="Description of Artificial Sequence: Synthetic oligonucleotide"

SEQ ID NO: 3122 - DNA, 36 bp, Artificial Sequence; identical to SEQ ID NO: 3003
  source: /note="Description of Artificial Sequence: Synthetic oligonucleotide"

SEQ ID NO: 3123 - DNA, 57 bp, Artificial Sequence; identical to SEQ ID NO: 2984
  source: /note="Description of Artificial Sequence: Synthetic oligonucleotide"

SEQ ID NO: 3124 - DNA, 36 bp, Artificial Sequence
  source: /note="Description of Artificial Sequence: Synthetic oligonucleotide"
ggaaaagtggctggtatgcctgaagcttttgaaatc

SEQ ID NO: 3125 - DNA, 60 bp, Artificial Sequence
  source: /note="Description of Artificial Sequence: Synthetic oligonucleotide"
gggggtgattacgtttgggggagttatcgtccctactactactactacggtatggacgtc

SEQ ID NO: 3126 - DNA, 36 bp, Artificial Sequence; identical to SEQ ID NO: 3124
  source: /note="Description of Artificial Sequence: Synthetic oligonucleotide"

SEQ ID NO: 3127 - DNA, 36 bp, Artificial Sequence; identical to SEQ ID NO: 3124
  source: /note="Description of Artificial Sequence: Synthetic oligonucleotide"

SEQ ID NO: 3128 - DNA, 36 bp, Artificial Sequence; identical to SEQ ID NO: 3124
  source: /note="Description of Artificial Sequence: Synthetic oligonucleotide"

SEQ ID NO: 3129 - DNA, 36 bp, Artificial Sequence; identical to SEQ ID NO: 3124
  source: /note="Description of Artificial Sequence: Synthetic oligonucleotide"

SEQ ID NO: 3130 - DNA, 36 bp, Artificial Sequence; identical to SEQ ID NO: 3124
  source: /note="Description of Artificial Sequence: Synthetic oligonucleotide"

SEQ ID NO: 3131 - DNA, 36 bp, Artificial Sequence; identical to SEQ ID NO: 3124
  source: /note="Description of Artificial Sequence: Synthetic oligonucleotide"

SEQ ID NO: 3132 - DNA, 60 bp, Artificial Sequence; identical to SEQ ID NO: 3125
  source: /note="Description of Artificial Sequence: Synthetic oligonucleotide"

SEQ ID NO: 3133 - DNA, 60 bp, Artificial Sequence; identical to SEQ ID NO: 3125
  source: /note="Description of Artificial Sequence: Synthetic oligonucleotide"

SEQ ID NO: 3134 - DNA, 60 bp, Artificial Sequence; identical to SEQ ID NO: 3125
  source: /note="Description of Artificial Sequence: Synthetic oligonucleotide"

SEQ ID NO: 3135 - DNA, 60 bp, Artificial Sequence; identical to SEQ ID NO: 3125
  source: /note="Description of Artificial Sequence: Synthetic oligonucleotide"

SEQ ID NO: 3136 - DNA, 60 bp, Artificial Sequence; identical to SEQ ID NO: 3125
  source: /note="Description of Artificial Sequence: Synthetic oligonucleotide"

SEQ ID NO: 3137 - DNA, 60 bp, Artificial Sequence; identical to SEQ ID NO: 3125
  source: /note="Description of Artificial Sequence: Synthetic oligonucleotide"

SEQ ID NO: 3138 - DNA, 60 bp, Artificial Sequence
  source: /note="Description of Artificial Sequence: Synthetic oligonucleotide"
gggggtgattacgttttcgggagttatcgtccctactactactactacggtatggacgtc

SEQ ID NO: 3139 - DNA, 60 bp, Artificial Sequence; identical to SEQ ID NO: 3138
  source: /note="Description of Artificial Sequence: Synthetic oligonucleotide"

SEQ ID NO: 3140 - DNA, 36 bp, Artificial Sequence; identical to SEQ ID NO: 3124
  source: /note="Description of Artificial Sequence: Synthetic oligonucleotide"

SEQ ID NO: 3141 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 3142 - DNA, 2024 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggat

SEQ ID NO: 3143 - protein, 430 aa, Homo sapiens
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 3144 - DNA, 1290 bp, Homo sapiens
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgc

SEQ ID NO: 3145 - protein, 493 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRRRGTAPPLSAIVSQVQSEIRRGWHHCRLRRSLGEEQRQLPERAFRALPSGSGPGEVPTSRGLSSGTLPGPGNEASRELESYC

SEQ ID NO: 3146 - DNA, 1482 bp, Homo sapiens
atgaccaccagcccgattctgcagctgctgctgcgcctgagcctgtgcggcctgctgctgcagcgcgcggaaaccggcagcaaaggccagaccgcgggcgaactgtatcagcgctgggaacgctatcgccgcgaatgccaggaaaccctggcggcggcggaaccgccgagcggcctggcgtgcaacggcagctttgatatgtatgtgtgctgggattatgcggcgccgaacgcgaccgcgcgcgcgagctgcccgtggtatctgccgtggcatcatcatgtggcggcgggctttgtgctgcgccagtgcggcagcgatggccagtggggcctgtggcgcgatcatacccagtgcgaaaacccggaaaaaaacgaagcgtttctggatcagcgcctgattctggaacgcctgcaggtgatgtataccgtgggctatagcctgagcctggcgaccctgctgctggcgctgctgattctgagcctgtttcgccgcctgcattgcacccgcaactatattcatattaacctgtttaccagctttatgctgcgcgcggcggcgattctgagccgcgatcgcctgctgccgcgcccgggcccgtatctgggcgatcaggcgctggcgctgtggaaccaggcgctggcggcgtgccgcaccgcgcagattgtgacccagtattgcgtgggcgcgaactatacctggctgctggtggaaggcgtgtatctgcatagcctgctggtgctggtgggcggcagcgaagaaggccattttcgctattatctgctgctgggctggggcgcgccggcgctgtttgtgattccgtgggtgattgtgcgctatctgtatgaaaacacccagtgctgggaacgcaacgaagtgaaagcgatttggtggattattcgcaccccgattctgatgaccattctgattaactttctgatttttattcgcattctgggcattctgctgagcaaactgcgcacccgccagatgcgctgccgcgattatcgcctgcgcctggcgcgcagcaccctgaccctggtgccgctgctgggcgtgcatgaagtggtgtttgcgccggtgaccgaagaacaggcgcgcggcgcgctgcgctttgcgaaactgggctttgaaatttttctgagcagctttcagggctttctggtgagcgtgctgtattgctttattaacaaagaagtgggccgcgatccggcggcggcgccggcgctgtggcgccgccgcggcaccgcgccgccgctgagcgcgattgtgagccaggtgcagagcgaaattcgccgcggctggcatcattgccgcctgcgccgcagcctgggcgaagaacagcgccagctgccggaacgcgcgtttcgcgcgctgccgagcggcagcggcccgggcgaagtgccgaccagccgcggcctgagcagcggcaccctgccgggcccgggcaacgaagcgagccgcgaactggaaagctattgctaa

SEQ ID NO: 3147 - protein, 460 aa, Mus musculus
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQALAACRTAQIMTQYCVGANYTWLLVEGVYLHHLLVIVGRSEKGHFRCYLLLGWGAPALFVIPWVIVRYLRENTQCWERNEVKAIWWIIRTPILITILINFLIFIRILGILVSKLRTRQMRCPDYRLRLARSTLTLVPLLGVHEVVFAPVTEEQVEGSLRFAKLAFEIFLSSFQGFLVSVLYCFINKEVQSEIRQGWRHRRLRLSLQEQRPRPHQELAPRAVPLSSACREAAVGNALPSGMLHVPGDEVLESYC

SEQ ID NO: 3148 - DNA, 1383 bp, Mus musculus
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggcgctggcggcgtgccgcaccgcgcagattatgacccagtattgcgtgggcgcgaactatacctggctgctggtggaaggcgtgtatctgcatcatctgctggtgattgtgggccgcagcgaaaaaggccattttcgctgctatctgctgctgggctggggcgcgccggcgctgtttgtgattccgtgggtgattgtgcgctatctgcgcgaaaacacccagtgctgggaacgcaacgaagtgaaagcgatttggtggattattcgcaccccgattctgattaccattctgattaactttctgatttttattcgcattctgggcattctggtgagcaaactgcgcacccgccagatgcgctgcccggattatcgcctgcgcctggcgcgcagcaccctgaccctggtgccgctgctgggcgtgcatgaagtggtgtttgcgccggtgaccgaagaacaggtggaaggcagcctgcgctttgcgaaactggcgtttgaaatttttctgagcagctttcagggctttctggtgagcgtgctgtattgctttattaacaaagaagtgcagagcgaaattcgccagggctggcgccatcgccgcctgcgcctgagcctgcaggaacagcgcccgcgcccgcatcaggaactggcgccgcgcgcggtgccgctgagcagcgcgtgccgcgaagcggcggtgggcaacgcgctgccgagcggcatgctgcatgtgccgggcgatgaagtgctggaaagctattgctaa

SEQ ID NO: 3149 - protein, 230 aa, Mus musculus
MPLRLLLLLLWLWGLQWAETDSEGQTTTGELYQRWEHYGQECQKMLETTEPPSGLACNGSFDMYACWNYTAANTTARVSCPWYLPWFRQVSAGFVFRQCGSDGQWGSWRDHTQCENPEKNGAFQDQTLILERLQIMYTVGYSLSLTTLLLALLILSLFRRLHCTRNYIHMNLFTSFMLRAAAILTRDQLLPPLGPYTGDQAPTPWNQVLHRLLPGGTKTFPIYFRTFPHH

SEQ ID NO: 3150 - DNA, 693 bp, Mus musculus
atgccgctgcgcctgctgctgctgctgctgtggctgtggggcctgcagtgggcggaaaccgatagcgaaggccagaccaccaccggcgaactgtatcagcgctgggaacattatggccaggaatgccagaaaatgctggaaaccaccgaaccgccgagcggcctggcgtgcaacggcagctttgatatgtatgcgtgctggaactataccgcggcgaacaccaccgcgcgcgtgagctgcccgtggtatctgccgtggtttcgccaggtgagcgcgggctttgtgtttcgccagtgcggcagcgatggccagtggggcagctggcgcgatcatacccagtgcgaaaacccggaaaaaaacggcgcgtttcaggatcagaccctgattctggaacgcctgcagattatgtataccgtgggctatagcctgagcctgaccaccctgctgctggcgctgctgattctgagcctgtttcgccgcctgcattgcacccgcaactatattcatatgaacctgtttaccagctttatgctgcgcgcggcggcgattctgacccgcgatcagctgctgccgccgctgggcccgtataccggcgatcaggcgccgaccccgtggaaccaggtgctgcatcgcctgctgccgggcggcaccaaaacctttccgatttattttcgcacctttccgcatcattaa

SEQ ID NO: 3151 - protein, 42 aa, Homo sapiens
YAEGTFISDYSIAMDKIHQQDFVNWLLAQKGKKNDWKHNITQ

SEQ ID NO: 3152 - DNA, 126 bp, Homo sapiens
tatgcggaaggcacctttattagcgattatagcattgcgatggataaaattcatcagcaggattttgtgaactggctgctggcgcagaaaggcaaaaaaaacgattggaaacataacattacccag

SEQ ID NO: 3153 - protein, 42 aa, Mus musculus
YAEGTFISDYSIAMDKIRQQDFVNWLLAQRGKKSDWKHNITQ

SEQ ID NO: 3154 - DNA, 126 bp, Mus musculus
tatgcggaaggcacctttattagcgattatagcattgcgatggataaaattcgccagcaggattttgtgaactggctgctggcgcagcgcggcaaaaaaagcgattggaaacataacattacccag

SEQ ID NO: 3155 - protein, 42 aa, Rattus sp.
YAEGTFISDYSIAMDKIRQQDFVNWLLAQKGKKNDWKHNLTQ

SEQ ID NO: 3156 - DNA, 126 bp, Rattus sp.
tatgcggaaggcacctttattagcgattatagcattgcgatggataaaattcgccagcaggattttgtgaactggctgctggcgcagaaaggcaaaaaaaacgattggaaacataacctgacccag

SEQ ID NO: 3157 - protein, 22 aa, Homo sapiens
MDMRVPAQLLGLLLLWLRGARC

SEQ ID NO: 3158 - DNA, 66 bp, Homo sapiens
atggacatgagagtgcctgcacagctgctgggcctgctgctgctgtggctgagaggcgccagatgc

SEQ ID NO: 3159 - protein, 19 aa, Homo sapiens
MAWALLLLTLLTQGTGSWA

SEQ ID NO: 3160 - DNA, 57 bp, Homo sapiens
atggcctgggctctgctgctcctcaccctcctcactcagggcacagggtcctgggcc

SEQ ID NO: 3161-3162 - skipped (2 entries)

SEQ ID NO: 3163 - protein, 39 aa, Heloderma suspectum
HGEGTFTSDLSKQMEEEAVRLFIEWLKNGGPSSGAPPPS

SEQ ID NO: 3164 - protein, 39 aa, Heloderma horridum
HSDGTFTSDLSKQMEEEAVRLFIEWLKNGGPSSGAPPPS

SEQ ID NO: 3165 - protein, 39 aa, Heloderma suspectum
HGEGTFTSDLSKQLEEEAVRLFIEWLKNGGPSSGAPPPS

SEQ ID NO: 3166 - protein, 39 aa, Heloderma suspectum
HGEGTFTSDLSKQLEEEAVRLFIEFLKNGGPSSGAPPPS

SEQ ID NO: 3167 - protein, 39 aa, Heloderma suspectum
HGEGTFTSDLSKQLEEEAARLFIEFLKNGGPSSGAPPPS

SEQ ID NO: 3168 - protein, 30 aa, Heloderma suspectum
HGEGTFTSDLSKQMEEEAVRLFIEWLKNGG

SEQ ID NO: 3169 - protein, 30 aa, Heloderma suspectum
HGEGTFTSDLSKQLEEEAVRLFIEWLKNGG

SEQ ID NO: 3170 - protein, 30 aa, Heloderma suspectum
HGEGTFTSDLSKQLEEEAVRLFIEFLKNGG

SEQ ID NO: 3171 - protein, 30 aa, Heloderma suspectum
HGEGTFTSDLSKQLEEEAARLFIEFLKNGG

SEQ ID NO: 3172 - protein, 28 aa, Heloderma suspectum
HGEGTFTSDLSKQMEEEAVRLFIEWLKN

SEQ ID NO: 3173 - protein, 28 aa, Heloderma suspectum
HGEGTFTSDLSKQLEEEAVRLFIEWLKN

SEQ ID NO: 3174 - protein, 28 aa, Heloderma suspectum
HGEGTFTSDLSKQLEEEAVRLFIEFLKN

SEQ ID NO: 3175 - protein, 28 aa, Heloderma suspectum
HGEGTFTSDLSKQLEEEAARLFIEFLKN

SEQ ID NO: 3176 - protein, 39 aa, Heloderma suspectum
HGEGTFTSDLSKQLEEKAAKEFIEFLKQGGPSSGAPPPS

SEQ ID NO: 3177 - protein, 39 aa, Heloderma suspectum
HGEGTFTSDLSKQLEEKAAKEFIEWLKQGGPSSGAPPPS

SEQ ID NO: 3178 - protein, 37 aa, Heloderma suspectum
HGEFTFTSDLSKQLEEEAVRLFIEWLKQGGPSKEIIS

SEQ ID NO: 3179 - protein, 39 aa, Heloderma suspectum
HGEFTFTSDLSKQLEEKAAKEFIEWLKQGGPSSGAPPPS

SEQ ID NO: 3180 - protein, 39 aa, Heloderma suspectum
HGEGTFTSDLVKILEAEAVRKFIEFLKNGGPSSGAPPPS

SEQ ID NO: 3181 - protein, 40 aa, Heloderma suspectum
HGEGTFTSDLSKQMEEEAVRLFIEWLKNGGPSSGAPPPSK

SEQ ID NO: 3182 - protein, 31 aa, Homo sapiens
HAEGTFTSDVSSYLEGQAAKEFIAWLVKGRG

SEQ ID NO: 3183 - protein, 31 aa, Artificial Sequence; identical to SEQ ID NO: 3182
  source: /note="Description of Artificial Sequence: Synthetic polypeptide"
  VARIANT (2)..(2): /replace="Val" or "Gly"
  VARIANT (16)..(16): /replace="Lys" or "Glu"
  VARIANT (17)..(17): /replace="Lys"
  VARIANT (24)..(24): /replace="Glu"
  VARIANT (27)..(27): /replace="Lys"
  VARIANT (28)..(28): /replace="Asn" or "Arg"
  VARIANT (30)..(30): /replace="Gly"
  VARIANT (31)..(31): /replace="His" or "Pro" or " "
  SITE (1)..(31): /note="Variant residues given in the sequence have no preference with respect to those in the annotations for variant positions"

SEQ ID NO: 3184 - protein, 31 aa, Artificial Sequence
  source: /note="Description of Artificial Sequence: Synthetic polypeptide"
HAEGTFTSDVSSYLEGQAAKEFIAWLVRGRG

SEQ ID NO: 3185 - protein, 31 aa, Artificial Sequence
  source: /note="Description of Artificial Sequence: Synthetic polypeptide"
HAEGTFTSDVSSYLEGQAAKEFIEWLVKGRG

SEQ ID NO: 3186 - protein, 31 aa, Artificial Sequence
  source: /note="Description of Artificial Sequence: Synthetic polypeptide"
HAEGTFTSDVSSYLEKQAAKEFIAWLVKGRG

SEQ ID NO: 3187 - protein, 31 aa, Artificial Sequence
  source: /note="Description of Artificial Sequence: Synthetic polypeptide"
HGEGTFTSDVSSYLEEQAAKEFIAWLVKGGG

SEQ ID NO: 3188 - protein, 31 aa, Artificial Sequence
  source: /note="Description of Artificial Sequence: Synthetic polypeptide"
HVEGTFTSDVSSYLEEQAAKEFIAWLVKGGG

SEQ ID NO: 3189 - protein, 31 aa, Artificial Sequence
  source: /note="Description of Artificial Sequence: Synthetic polypeptide"
HGEGTFTSDVSSYLEEQAAKEFIAWLKNGGG

SEQ ID NO: 3190 - protein, 31 aa, Artificial Sequence
  source: /note="Description of Artificial Sequence: Synthetic polypeptide"
HVEGTFTSDVSSYLEEQAAKEFIAWLKNGGG

SEQ ID NO: 3191 - protein, 31 aa, Artificial Sequence
  source: /note="Description of Artificial Sequence: Synthetic polypeptide"
HGEGTFTSDVSSYLEEQAAKEFIAWLVKGGP

SEQ ID NO: 3192 - protein, 31 aa, Artificial Sequence
  source: /note="Description of Artificial Sequence: Synthetic polypeptide"
HVEGTFTSDVSSYLEEQAAKEFIAWLVKGGP

SEQ ID NO: 3193 - protein, 31 aa, Artificial Sequence
  source: /note="Description of Artificial Sequence: Synthetic polypeptide"
HGEGTFTSDVSSYLEEQAAKEFIAWLKNGGP

SEQ ID NO: 3194 - protein, 31 aa, Artificial Sequence
  source: /note="Description of Artificial Sequence: Synthetic polypeptide"
HVEGTFTSDVSSYLEEQAAKEFIAWLKNGGP

SEQ ID NO: 3195 - protein, 30 aa, Artificial Sequence
  source: /note="Description of Artificial Sequence: Synthetic polypeptide"
HGEGTFTSDVSSYLEEQAAKEFIAWLVKGG

SEQ ID NO: 3196 - protein, 30 aa, Artificial Sequence
  source: /note="Description of Artificial Sequence: Synthetic polypeptide"
HVEGTFTSDVSSYLEEQAAKEFIAWLVKGG

SEQ ID NO: 3197 - protein, 30 aa, Artificial Sequence
  source: /note="Description of Artificial Sequence: Synthetic polypeptide"
HVEGTFTSDVSSYLEEQAAKEFIAWLVNGG

SEQ ID NO: 3198 - protein, 30 aa, Artificial Sequence
  source: /note="Description of Artificial Sequence: Synthetic polypeptide"
HGEGTFTSDVSSYLEEQAAKEFIAWLVNGG

SEQ ID NO: 3199 - protein, 40 aa, Artificial Sequence
  source: /note="Description of Artificial Sequence: Synthetic polypeptide"
  VARIANT (2)..(2): /replace="D-Ala" or "Val" or "Leu" or "Ile" "Ser" or "Thr"
  VARIANT (16)..(16): /replace="Glu" or "Asp" or "Lys"
  VARIANT (27)..(27): /replace="Ile"
  SITE (1)..(40): /note="Variant residues given in the sequence have no preference with respect to those in the annotations for variant positions"
HGEGTFTSDVSSYLEGQAAKEFIAWLVKGGPSSGAPPPCC

SEQ ID NO: 3200 - protein, 40 aa, Artificial Sequence
  source: /note="Description of Artificial Sequence: Synthetic polypeptide"
HVEGTFTSDVSSYLEEQAAKEFIAWLIKGGPSSGAPPPCC

SEQ ID NO: 3201 - protein, 31 aa, Artificial Sequence; identical to SEQ ID NO: 3187
  source: /note="Description of Artificial Sequence: Synthetic polypeptide"

SEQ ID NO: 3202 - protein, 31 aa, Homo sapiens; identical to SEQ ID NO: 3182

SEQ ID NO: 3203 - protein, 30 aa, Artificial Sequence
  source: /note="Description of Artificial Sequence: Synthetic polypeptide"
AEGTFTSDVSSYLEGQAAKEFIAWLVKGRG

SEQ ID NO: 3204 - protein, 29 aa, Artificial Sequence
  source: /note="Description of Artificial Sequence: Synthetic peptide"
EGTFTSDVSSYLEGQAAKEFIAWLVKGRG

SEQ ID NO: 3205 - protein, 31 aa, Artificial Sequence
  source: /note="Description of Artificial Sequence: Synthetic polypeptide"
HGEGTFTSDVSSYLEGQAAKEFIAWLVKGRG

SEQ ID NO: 3206 - protein, 30 aa, Artificial Sequence
  source: /note="Description of Artificial Sequence: Synthetic polypeptide"
HGEGTFTSDVSSYLEGQAAKEFIAWLVKGR

SEQ ID NO: 3207 - protein, 31 aa, Artificial Sequence
  source: /note="Description of Artificial Sequence: Synthetic polypeptide"
HLEGTFTSDVSSYLEGQAAKEFIAWLVKGRG

SEQ ID NO: 3208 - protein, 22 aa, Artificial Sequence
  source: /note="Description of Artificial Sequence: Synthetic peptide"
HGEGTFTSDLSKQMEEEAVRLF

SEQ ID NO: 3209 - protein, 23 aa, Artificial Sequence
  source: /note="Description of Artificial Sequence: Synthetic peptide"
HGEGTFTSDLSKQMEEEAVRLFI

SEQ ID NO: 3210 - protein, 31 aa, Artificial Sequence
  source: /note="Description of Artificial Sequence: Synthetic polypeptide"
HGEGTFTSDVSSYLEGQAAKEFIAWLVKGGG

SEQ ID NO: 3211 - protein, 31 aa, Artificial Sequence
  source: /note="Description of Artificial Sequence: Synthetic polypeptide"
HGEGTFTSDLSKQMEEEAVRLAAQAAQQGGG

SEQ ID NO: 3212 - protein, 31 aa, Artificial Sequence
  source: /note="Description of Artificial Sequence: Synthetic polypeptide"
HSEGTFTSDVSSYLEEQAAKEFIAWLVKGGG

SEQ ID NO: 3213 - protein, 31 aa, Artificial Sequence
  source: /note="Description of Artificial Sequence: Synthetic polypeptide"
HSQGTFTSDVSSYLEEQAAKEFIAWLVKGGG

SEQ ID NO: 3214 - protein, 31 aa, Artificial Sequence
  source: /note="Description of Artificial Sequence: Synthetic polypeptide"
HGDGTFTSDVSSYLEEQAAKEFIAWLVKGGG

SEQ ID NO: 3215 - protein, 31 aa, Artificial Sequence
  source: /note="Description of Artificial Sequence: Synthetic polypeptide"
HSDGTFTSDVSSYLEEQAAKEFIAWLVKGGG

SEQ ID NO: 3216 - protein, 31 aa, Artificial Sequence
  source: /note="Description of Artificial Sequence: Synthetic polypeptide"
HSEGTFTSDVSSYLEEQAAKEFIEWLVKGGG

SEQ ID NO: 3217 - protein, 31 aa, Artificial Sequence
  source: /note="Description of Artificial Sequence: Synthetic polypeptide"
HSQGTFTSDVSSYLEEQAAKEFIEWLVKGGG

SEQ ID NO: 3218 - protein, 31 aa, Artificial Sequence
  source: /note="Description of Artificial Sequence: Synthetic polypeptide"
HGDGTFTSDVSSYLEEQAAKEFIEWLVKGGG

SEQ ID NO: 3219 - protein, 31 aa, Artificial Sequence
  source: /note="Description of Artificial Sequence: Synthetic polypeptide"
HSDGTFTSDVSSYLEEQAAKEFIEWLVKGGG

SEQ ID NO: 3220 - protein, 31 aa, Artificial Sequence; identical to SEQ ID NO: 3189
  source: /note="Description of Artificial Sequence: Synthetic polypeptide"

SEQ ID NO: 3221 - protein, 31 aa, Artificial Sequence
  source: /note="Description of Artificial Sequence: Synthetic polypeptide"
HSEGTFTSDVSSYLEEQAAKEFIAWLKNGGG

SEQ ID NO: 3222 - protein, 31 aa, Artificial Sequence
  source: /note="Description of Artificial Sequence: Synthetic polypeptide"
HSQGTFTSDVSSYLEEQAAKEFIAWLKNGGG

SEQ ID NO: 3223 - protein, 31 aa, Artificial Sequence
  source: /note="Description of Artificial Sequence: Synthetic polypeptide"
HGDGTFTSDVSSYLEEQAAKEFIAWLKNGGG

SEQ ID NO: 3224 - protein, 31 aa, Artificial Sequence
  source: /note="Description of Artificial Sequence: Synthetic polypeptide"
HSDGTFTSDVSSYLEEQAAKEFIAWLKNGGG

SEQ ID NO: 3225 - protein, 31 aa, Artificial Sequence
  source: /note="Description of Artificial Sequence: Synthetic polypeptide"
HSEGTFTSDVSSYLEEQAAKEFIEWLKNGGG

SEQ ID NO: 3226 - protein, 31 aa, Artificial Sequence
  source: /note="Description of Artificial Sequence: Synthetic polypeptide"
HSQGTFTSDVSSYLEEQAAKEFIEWLKNGGG

SEQ ID NO: 3227 - protein, 31 aa, Artificial Sequence
  source: /note="Description of Artificial Sequence: Synthetic polypeptide"
HGDGTFTSDVSSYLEEQAAKEFIEWLKNGGG

SEQ ID NO: 3228 - protein, 31 aa, Artificial Sequence
  source: /note="Description of Artificial Sequence: Synthetic polypeptide"
HSDGTFTSDVSSYLEEQAAKEFIEWLKNGGG

SEQ ID NO: 3229 - protein, 31 aa, Artificial Sequence
  source: /note="Description of Artificial Sequence: Synthetic polypeptide"
HGEGTFTSDVSSYLEEQAAKEFIEWLKNEGG

SEQ ID NO: 3230 - protein, 31 aa, Artificial Sequence
  source: /note="Description of Artificial Sequence: Synthetic polypeptide"
HSEGTFTSDVSSYLEEQAAKEFIEWLKNEGG

SEQ ID NO: 3231 - protein, 31 aa, Artificial Sequence
  source: /note="Description of Artificial Sequence: Synthetic polypeptide"
HGEGTFTSDVSSYLEEQAAKEFIEWLKNPGG

SEQ ID NO: 3232 - protein, 31 aa, Artificial Sequence
  source: /note="Description of Artificial Sequence: Synthetic polypeptide"
HSEGTFTSDVSSYLEEQAAKEFIEWLKNPGG

SEQ ID NO: 3233 - protein, 31 aa, Artificial Sequence
  source: /note="Description of Artificial Sequence: Synthetic polypeptide"
HGEGTFTSDVSSYLEEQAAKEFIEWLKNQGG

SEQ ID NO: 3234 - protein, 31 aa, Artificial Sequence
  source: /note="Description of Artificial Sequence: Synthetic polypeptide"
HSEGTFTSDVSSYLEEQAAKEFIEWLKNQGG

SEQ ID NO: 3235 - protein, 31 aa, Artificial Sequence
  source: /note="Description of Artificial Sequence: Synthetic polypeptide"
HGEGTFTSDVSSYLEEQAAKEFIEWLKNTGG

SEQ ID NO: 3236 - protein, 31 aa, Artificial Sequence
  source: /note="Description of Artificial Sequence: Synthetic polypeptide"
HSEGTFTSDVSSYLEEQAAKEFIEWLKNTGG

SEQ ID NO: 3237 - protein, 31 aa, Artificial Sequence
  source: /note="Description of Artificial Sequence: Synthetic polypeptide"
HGEGTFTSDVSSYLEEQAAKEFIEWLKNVGG

SEQ ID NO: 3238 - protein, 31 aa, Artificial Sequence
  source: /note="Description of Artificial Sequence: Synthetic polypeptide"
HSEGTFTSDVSSYLEEQAAKEFIEWLKNVGG

SEQ ID NO: 3239 - protein, 31 aa, Artificial Sequence
  source: /note="Description of Artificial Sequence: Synthetic polypeptide"
HGEGTFTSDVSSYLEEQAAKEFIEWLKQGGG

SEQ ID NO: 3240 - protein, 31 aa, Artificial Sequence
  source: /note="Description of Artificial Sequence: Synthetic polypeptide"
HSEGTFTSDVSSYLEEQAAKEFIEWLKQGGG

SEQ ID NO: 3241 - protein, 31 aa, Artificial Sequence; identical to SEQ ID NO: 3187
  source: /note="Description of Artificial Sequence: Synthetic polypeptide"

SEQ ID NO: 3242 - protein, 31 aa, Artificial Sequence
  source: /note="Description of Artificial Sequence: Synthetic polypeptide"
  MOD_RES (12)..(12): Any amino acid
HGEGTFTSDVSXYLEEQAAKEFIAWLVKGGG

SEQ ID NO: 3243 - protein, 31 aa, Artificial Sequence
  source: /note="Description of Artificial Sequence: Synthetic polypeptide"
HVEGTFTSDVSSYLEGQAAKEFIAWLVKGGG

SEQ ID NO: 3244 - protein, 31 aa, Artificial Sequence
  source: /note="Description of Artificial Sequence: Synthetic polypeptide"
HSEGTFTSDVSSYLEGQAAKEFIAWLVKGGG

SEQ ID NO: 3245 - protein, 31 aa, Artificial Sequence
  source: /note="Description of Artificial Sequence: Synthetic polypeptide"
HGQGTFTSDVSSYLEGQAAKEFIAWLVKGGG

SEQ ID NO: 3246 - protein, 31 aa, Artificial Sequence
  source: /note="Description of Artificial Sequence: Synthetic polypeptide"
HVQGTFTSDVSSYLEGQAAKEFIAWLVKGGG

SEQ ID NO: 3247 - protein, 31 aa, Artificial Sequence
  source: /note="Description of Artificial Sequence: Synthetic polypeptide"
HSQGTFTSDVSSYLEGQAAKEFIAWLVKGGG

SEQ ID NO: 3248 - protein, 31 aa, Artificial Sequence
  source: /note="Description of Artificial Sequence: Synthetic polypeptide"
HVDGTFTSDVSSYLEGQAAKEFIAWLVKGGG

SEQ ID NO: 3249 - protein, 31 aa, Artificial Sequence
  source: /note="Description of Artificial Sequence: Synthetic polypeptide"
HGHGTFTSDVSSYLEGQAAKEFIAWLVKGGG

SEQ ID NO: 3250 - protein, 31 aa, Artificial Sequence
  source: /note="Description of Artificial Sequence: Synthetic polypeptide"
HVHGTFTSDVSSYLEGQAAKEFIAWLVKGGG

SEQ ID NO: 3251 - protein, 31 aa, Artificial Sequence
  source: /note="Description of Artificial Sequence: Synthetic polypeptide"
HSHGTFTSDVSSYLEGQAAKEFIAWLVKGGG

SEQ ID NO: 3252 - protein, 31 aa, Artificial Sequence
  source: /note="Description of Artificial Sequence: Synthetic polypeptide"
HGDGTFTSDVSSYLEGQAAKEFIAWLVKGGG

SEQ ID NO: 3253 - protein, 31 aa, Artificial Sequence
  source: /note="Description of Artificial Sequence: Synthetic polypeptide"
HSDGTFTSDVSSYLEGQAAKEFIAWLVKGGG

SEQ ID NO: 3254 - protein, 31 aa, Artificial Sequence
  source: /note="Description of Artificial Sequence: Synthetic polypeptide"
HGEGTFTSDVSSYLEEQAAKEFIEWLKNGGG

SEQ ID NO: 3255 - protein, 31 aa, Artificial Sequence
  source: /note="Description of Artificial Sequence: Synthetic polypeptide"
HGEGTFTSDVSSYLEEQAAKEFIEWLVKGGG

SEQ ID NO: 3256 - protein, 31 aa, Artificial Sequence
  source: /note="Description of Artificial Sequence: Synthetic polypeptide"
HGEGTFTSDYSSYLEEQAAKEFIEWLKNGGG

SEQ ID NO: 3257 - protein, 31 aa, Artificial Sequence
  source: /note="Description of Artificial Sequence: Synthetic polypeptide"
HGEGTFTSEVSSYLEGQAAKEFIEWLKNGGG

SEQ ID NO: 3258 - protein, 32 aa, Artificial Sequence
  source: /note="Description of Artificial Sequence: Synthetic polypeptide"
HSEGTFTSDLSKQMEEEAVRLFAAQAAQQGGG

SEQ ID NO: 3259 - protein, 32 aa, Artificial Sequence
  source: /note="Description of Artificial Sequence: Synthetic polypeptide"
HSQGTFTSDLSKQMEEEAVRLFAAQAAQQGGG

SEQ ID NO: 3260 - protein, 32 aa, Artificial Sequence
  source: /note="Description of Artificial Sequence: Synthetic polypeptide"
HGDGTFTSDLSKQMEEEAVRLFAAQAAQQGGG

SEQ ID NO: 3261 - protein, 32 aa, Artificial Sequence
  source: /note="Description of Artificial Sequence: Synthetic polypeptide"
HSDGTFTSDLSKQMEEEAVRLFAAQAAQQGGG

SEQ ID NO: 3262 - protein, 32 aa, Artificial Sequence
  source: /note="Description of Artificial Sequence: Synthetic polypeptide"
HGEGTFTSDLSKQMEEEAVRLFAAQAAQQGGG

SEQ ID NO: 3263 - protein, 30 aa, Artificial Sequence; identical to SEQ ID NO: 3168
  source: /note="Description of Artificial Sequence: Synthetic polypeptide"

SEQ ID NO: 3264 - protein, 30 aa, Artificial Sequence
  source: /note="Description of Artificial Sequence: Synthetic polypeptide"
HGEGTFTSDVSSYLEGEAVRLFIEWLKNGG

SEQ ID NO: 3265 - protein, 39 aa, Artificial Sequence; identical to SEQ ID NO: 3163
  source: /note="Description of Artificial Sequence: Synthetic polypeptide"

SEQ ID NO: 3266 - protein, 39 aa, Artificial Sequence
  source: /note="Description of Artificial Sequence: Synthetic polypeptide"
HGEGTFTSDVSSYLEGEAVRLFIEWLKNGGPSSGAPPPS

SEQ ID NO: 3267 - protein, 32 aa, Artificial Sequence
  source: /note="Description of Artificial Sequence: Synthetic polypeptide"
HHGEGTFTSDVSSYLEEQAAKEFIEWLKNGGG

SEQ ID NO: 3268 - protein, 32 aa, Artificial Sequence
  source: /note="Description of Artificial Sequence: Synthetic polypeptide"
HHGEGTFTSDVSSYLEEQAAKEFIEWLKDGGG

SEQ ID NO: 3269 - protein, 32 aa, Artificial Sequence
  source: /note="Description of Artificial Sequence: Synthetic polypeptide"
HHGEGTFTSDVSSYLEEQAAKEFIEWLKQGGG

SEQ ID NO: 3270 - protein, 32 aa, Artificial Sequence
  source: /note="Description of Artificial Sequence: Synthetic polypeptide"
HHGEGTFTSDVSSYLEEQAAKEFIEWLKNQGG

SEQ ID NO: 3271 - protein, 32 aa, Artificial Sequence
  source: /note="Description of Artificial Sequence: Synthetic polypeptide"
HHGEGTFTSDVSSYLEEQAAKEFIEWLKNTGG

SEQ ID NO: 3272 - protein, 32 aa, Artificial Sequence
  source: /note="Description of Artificial Sequence: Synthetic polypeptide"
HHGEGTFTSDVSSYLEEQAAKEFIEWLKNVGG

SEQ ID NO: 3273 - protein, 32 aa, Artificial Sequence
  source: /note="Description of Artificial Sequence: Synthetic polypeptide"
HHGEGTFTSDVSSYLEEQAAKEFIEWLKNPGG

SEQ ID NO: 3274 - protein, 32 aa, Artificial Sequence
  source: /note="Description of Artificial Sequence: Synthetic polypeptide"
HHGEGTFTSDVSSYLEEQAAKEFIEWLKNEGG

SEQ ID NO: 3275 - protein, 29 aa, Artificial Sequence
  source: /note="Description of Artificial Sequence: Synthetic peptide"
HGAGTFTSDVSSYLEGQAAKEFIAWLVKG

SEQ ID NO: 3276 - protein, 29 aa, Artificial Sequence
  source: /note="Description of Artificial Sequence: Synthetic peptide"
HGDGTFTSDVSSYLEGQAAKEFIAWLVKG

SEQ ID NO: 3277 - protein, 29 aa, Artificial Sequence
  source: /note="Description of Artificial Sequence: Synthetic peptide"
HGLGTFTSDVSSYLEGQAAKEFIAWLVKG

SEQ ID NO: 3278 - protein, 29 aa, Artificial Sequence
  source: /note="Description of Artificial Sequence: Synthetic peptide"
HGVGTFTSDVSSYLEGQAAKEFIAWLVKG

SEQ ID NO: 3279 - protein, 29 aa, Artificial Sequence
  source: /note="Description of Artificial Sequence: Synthetic peptide"
HGFGTFTSDVSSYLEGQAAKEFIAWLVKG

SEQ ID NO: 3280 - protein, 29 aa, Artificial Sequence
  source: /note="Description of Artificial Sequence: Synthetic peptide"
HGYGTFTSDVSSYLEGQAAKEFIAWLVKG

SEQ ID NO: 3281 - protein, 29 aa, Artificial Sequence
  source: /note="Description of Artificial Sequence: Synthetic peptide"
HGTGTFTSDVSSYLEGQAAKEFIAWLVKG

SEQ ID NO: 3282 - protein, 29 aa, Artificial Sequence
  source: /note="Description of Artificial Sequence: Synthetic peptide"
HGNGTFTSDVSSYLEGQAAKEFIAWLVKG

SEQ ID NO: 3283 - protein, 29 aa, Artificial Sequence
  source: /note="Description of Artificial Sequence: Synthetic peptide"
HGHGTFTSDVSSYLEGQAAKEFIAWLVKG

SEQ ID NO: 3284 - protein, 29 aa, Artificial Sequence
  source: /note="Description of Artificial Sequence: Synthetic peptide"
HGKGTFTSDVSSYLEGQAAKEFIAWLVKG

SEQ ID NO: 3285 - protein, 29 aa, Artificial Sequence
  source: /note="Description of Artificial Sequence: Synthetic peptide"
HGIGTFTSDVSSYLEGQAAKEFIAWLVKG

SEQ ID NO: 3286 - protein, 29 aa, Artificial Sequence
  source: /note="Description of Artificial Sequence: Synthetic peptide"
HGWGTFTSDVSSYLEGQAAKEFIAWLVKG

SEQ ID NO: 3287 - protein, 29 aa, Artificial Sequence
  source: /note="Description of Artificial Sequence: Synthetic peptide"
HGPGTFTSDVSSYLEGQAAKEFIAWLVKG

SEQ ID NO: 3288 - protein, 29 aa, Artificial Sequence
  source: /note="Description of Artificial Sequence: Synthetic peptide"
HGSGTFTSDVSSYLEGQAAKEFIAWLVKG

SEQ ID NO: 3289 - protein, 29 aa, Artificial Sequence
  source: /note="Description of Artificial Sequence: Synthetic peptide"
HGRGTFTSDVSSYLEGQAAKEFIAWLVKG

SEQ ID NO: 3290 - protein, 30 aa, Artificial Sequence
  source: /note="Description of Artificial Sequence: Synthetic polypeptide"
AHGEGTFTSDVSSYLEGQAAKEFIAWLVKG

SEQ ID NO: 3291 - protein, 30 aa, Artificial Sequence
  source: /note="Description of Artificial Sequence: Synthetic polypeptide"
GHGEGTFTSDVSSYLEGQAAKEFIAWLVKG

SEQ ID NO: 3292 - protein, 30 aa, Artificial Sequence
  source: /note="Description of Artificial Sequence: Synthetic polypeptide"
HHGEGTFTSDVSSYLEGQAAKEFIAWLVKG

SEQ ID NO: 3293 - protein, 29 aa, Artificial Sequence
  source: /note="Description of Artificial Sequence: Synthetic peptide"
HHEGTFTSDVSSYLEGQAAKEFIAWLVKG

SEQ ID NO: 3294 - protein, 29 aa, Artificial Sequence
  source: /note="Description of Artificial Sequence: Synthetic peptide"
HGEATFTSDVSSYLEGQAAKEFIAWLVKG

SEQ ID NO: 3295 - protein, 29 aa, Artificial Sequence
  source: /note="Description of Artificial Sequence: Synthetic peptide"
HGESTFTSDVSSYLEGQAAKEFIAWLVKG

SEQ ID NO: 3296 - protein, 29 aa, Artificial Sequence
  source: /note="Description of Artificial Sequence: Synthetic peptide"
HGEVTFTSDVSSYLEGQAAKEFIAWLVKG

SEQ ID NO: 3297 - protein, 29 aa, Artificial Sequence
  source: /note="Description of Artificial Sequence: Synthetic peptide"
HGEKTFTSDVSSYLEGQAAKEFIAWLVKG

SEQ ID NO: 3298 - protein, 29 aa, Artificial Sequence
  source: /note="Description of Artificial Sequence: Synthetic peptide"
HGEETFTSDVSSYLEGQAAKEFIAWLVKG

SEQ ID NO: 3299 - protein, 29 aa, Artificial Sequence
  source: /note="Description of Artificial Sequence: Synthetic peptide"
HGEGTFTSDVSSYLEGQAAKEFIAWLVKG

SEQ ID NO: 3300 - protein, 31 aa, Artificial Sequence
  source: /note="Description of Artificial Sequence: Synthetic polypeptide"
HVEGTFTSDVSSYLEGQAAKEFIAWLVKGRG

SEQ ID NO: 3301 - protein, 31 aa, Artificial Sequence
  source: /note="Description of Artificial Sequence: Synthetic polypeptide"
HSEGTFTSDVSSYLEGQAAKEFIAWLVKGRG

SEQ ID NO: 3302 - protein, 31 aa, Artificial Sequence
  source: /note="Description of Artificial Sequence: Synthetic polypeptide"
HGQGTFTSDVSSYLEGQAAKEFIAWLVKGRG

SEQ ID NO: 3303 - protein, 8 aa, Artificial Sequence
  source: /note="Description of Artificial Sequence: Synthetic peptide"
GGGSGGGS

SEQ ID NO: 3304 - protein, 10 aa, Artificial Sequence
  source: /note="Description of Artificial Sequence: Synthetic peptide"
GGGGSGGGGS

SEQ ID NO: 3305 - protein, 12 aa, Artificial Sequence
  source: /note="Description of Artificial Sequence: Synthetic peptide"
GGGSGGGSGGGS

SEQ ID NO: 3306 - protein, 15 aa, Artificial Sequence
  source: /note="Description of Artificial Sequence: Synthetic peptide"
GGGGSGGGGSGGGGS

SEQ ID NO: 3307 - protein, 16 aa, Artificial Sequence
  source: /note="Description of Artificial Sequence: Synthetic peptide"
GGGSGGGSGGGSGGGS

SEQ ID NO: 3308 - protein, 20 aa, Artificial Sequence
  source: /note="Description of Artificial Sequence: Synthetic peptide"
GGGGSGGGGSGGGGSGGGGS

SEQ ID NO: 3309 - protein, 20 aa, Artificial Sequence
  source: /note="Description of Artificial Sequence: Synthetic peptide"
GGGSGGGSGGGSGGGSGGGS

SEQ ID NO: 3310 - protein, 25 aa, Artificial Sequence
  source: /note="Description of Artificial Sequence: Synthetic peptide"
GGGGSGGGGSGGGGSGGGGSGGGGS

SEQ ID NO: 3311 - protein, 24 aa, Artificial Sequence
  source: /note="Description of Artificial Sequence: Synthetic peptide"
GGGSGGGSGGGSGGGSGGGSGGGS

SEQ ID NO: 3312 - protein, 6 aa, Artificial Sequence
  source: /note="Description of Artificial Sequence: Synthetic peptide"
GGEGGG

SEQ ID NO: 3313 - protein, 8 aa, Artificial Sequence
  source: /note="Description of Artificial Sequence: Synthetic peptide"
GGEEEGGG

SEQ ID NO: 3314 - protein, 5 aa, Artificial Sequence
  source: /note="Description of Artificial Sequence: Synthetic peptide"
GEEEG

SEQ ID NO: 3315 - protein, 4 aa, Artificial Sequence
  source: /note="Description of Artificial Sequence: Synthetic peptide"
GEEE

SEQ ID NO: 3316 - protein, 6 aa, Artificial Sequence
  source: /note="Description of Artificial Sequence: Synthetic peptide"
GGDGGG

SEQ ID NO: 3317 - protein, 7 aa, Artificial Sequence
  source: /note="Description of Artificial Sequence: Synthetic peptide"
GGDDDGG

SEQ ID NO: 3318 - protein, 5 aa, Artificial Sequence
  source: /note="Description of Artificial Sequence: Synthetic peptide"
GDDDG

SEQ ID NO: 3319 - protein, 4 aa, Artificial Sequence
  source: /note="Description of Artificial Sequence: Synthetic peptide"
GDDD

SEQ ID NO: 3320 - protein, 21 aa, Artificial Sequence
  source: /note="Description of Artificial Sequence: Synthetic peptide"
GGGGSDDSDEGSDGEDGGGGS

SEQ ID NO: 3321 - protein, 5 aa, Artificial Sequence
  source: /note="Description of Artificial Sequence: Synthetic peptide"
WEWEW

SEQ ID NO: 3322 - protein, 5 aa, Artificial Sequence
  source: /note="Description of Artificial Sequence: Synthetic peptide"
FEFEF

SEQ ID NO: 3323 - protein, 6 aa, Artificial Sequence
  source: /note="Description of Artificial Sequence: Synthetic peptide"
EEEWWW

SEQ ID NO: 3324 - protein, 6 aa, Artificial Sequence
  source: /note="Description of Artificial Sequence: Synthetic peptide"
EEEFFF

SEQ ID NO: 3325 - protein, 7 aa, Artificial Sequence
  source: /note="Description of Artificial Sequence: Synthetic peptide"
WWEEEWW

SEQ ID NO: 3326 - protein, 7 aa, Artificial Sequence
  source: /note="Description of Artificial Sequence: Synthetic peptide"
FFEEEFF

SEQ ID NO: 3327 - protein, 4 aa, Artificial Sequence
  source: /note="Description of Artificial Sequence: Synthetic peptide"
GGGG

SEQ ID NO: 3328 - protein, 9 aa, Artificial Sequence
  source: /note="Description of Artificial Sequence: Synthetic peptide"
GGGGSGGGG

SEQ ID NO: 3329 - protein, 10 aa, Artificial Sequence
  source: /note="Description of Artificial Sequence: Synthetic peptide"
GAPAPAPAPG

SEQ ID NO: 3330 - protein, 14 aa, Artificial Sequence
  source: /note="Description of Artificial Sequence: Synthetic peptide"
GGGGAGGGGAGGGG

SEQ ID NO: 3331 - protein, 14 aa, Artificial Sequence
  source: /note="Description of Artificial Sequence: Synthetic peptide"
GAPAPAPAPAPAPG

SEQ ID NO: 3332 - protein, 18 aa, Artificial Sequence
  source: /note="Description of Artificial Sequence: Synthetic peptide"
GAPAPAPAPAPAPAPAPG

SEQ ID NO: 3333 - protein, 19 aa, Artificial Sequence
  source: /note="Description of Artificial Sequence: Synthetic peptide"
GGGGAGGGGAGGGGAGGGG

SEQ ID NO: 3334 - protein, 22 aa, Artificial Sequence
  source: /note="Description of Artificial Sequence: Synthetic peptide"
GAPAPAPAPAPAPAPAPAPAPG

SEQ ID NO: 3335 - protein, 23 aa, Artificial Sequence
  source: /note="Description of Artificial Sequence: Synthetic peptide"
GSGSATGGSGSVASSGSGSATGS

SEQ ID NO: 3336 - protein, 23 aa, Artificial Sequence
  source: /note="Description of Artificial Sequence: Synthetic peptide"
GSGSATGGSGSVASSGSGSATHL

SEQ ID NO: 3337 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXNXXG

SEQ ID NO: 3338 - protein, 5 aa, Artificial Sequence
  source: /note="Description of Artificial Sequence: Synthetic peptide"
GGGGG

SEQ ID NO: 3339 - protein, 7 aa, Artificial Sequence
  source: /note="Description of Artificial Sequence: Synthetic peptide"
GGGGGGG

SEQ ID NO: 3340 - protein, 15 aa, Artificial Sequence
  source: /note="Description of Artificial Sequence: Synthetic peptide"
GGGGSGGGGSGGGGS

SEQ ID NO: 3341 - protein, 6 aa, Artificial Sequence
  source: /note="Description of Artificial Sequence: Synthetic peptide"
GGGGGK

SEQ ID NO: 3342 - protein, 7 aa, Artificial Sequence
  source: /note="Description of Artificial Sequence: Synthetic peptide"
GGGGGKR

SEQ ID NO: 3343 - protein, 8 aa, Artificial Sequence
  source: /note="Description of Artificial Sequence: Synthetic peptide"
GGGKGGGG

SEQ ID NO: 3344 - protein, 8 aa, Artificial Sequence
  source: /note="Description of Artificial Sequence: Synthetic peptide"
GGGNGSGG

SEQ ID NO: 3345 - protein, 8 aa, Artificial Sequence
  source: /note="Description of Artificial Sequence: Synthetic peptide"
GGGCGGGG

SEQ ID NO: 3346 - protein, 8 aa, Artificial Sequence
  source: /note="Description of Artificial Sequence: Synthetic peptide"
GGGKGGGG

SEQ ID NO: 3347 - protein, 5 aa, Artificial Sequence
  source: /note="Description of Artificial Sequence: Synthetic peptide"
GGGGS

SEQ ID NO: 3348 - protein, 10 aa, Artificial Sequence
  source: /note="Description of Artificial Sequence: Synthetic peptide"
GGGGSGGGGS

SEQ ID NO: 3349 - protein, 20 aa, Artificial Sequence
  source: /note="Description of Artificial Sequence: Synthetic peptide"
GGGGSGGGGSGGGGSGGGGS

SEQ ID NO: 3350 - protein, 25 aa, Artificial Sequence
  source: /note="Description of Artificial Sequence: Synthetic peptide"
GGGGSGGGGSGGGGSGGGGSGGGGS

SEQ ID NO: 3351 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXYXXG

SEQ ID NO: 3352 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXSXXG

SEQ ID NO: 3353 - protein, 6 aa, Artificial Sequence
  source: /note="Description of Artificial Sequence: Synthetic peptide"
  MOD_RES (1)..(2): Any amino acid
  MOD_RES (4)..(5): Any amino acid
XXTXXG

SEQ ID NO: 3354 - protein, 22 aa, Artificial Sequence
  source: /note="Description of Artificial Sequence: Synthetic peptide"
HGSGSATGGSGSTASSGSGSAT

SEQ ID NO: 3355 - protein, 19 aa, Artificial Sequence
  source: /note="Description of Artificial Sequence: Synthetic peptide"
AEAAAKEAAAKEAAAKAGG

SEQ ID NO: 3356 - protein, 22 aa, Artificial Sequence
  source: /note="Description of Artificial Sequence: Synthetic peptide"
GSGSATGGSGSTASSGSGSATH

SEQ ID NO: 3357 - protein, 5 aa, Artificial Sequence
  source: /note="Description of Artificial Sequence: Synthetic peptide"
GPNGG

SEQ ID NO: 3358 - protein, 6 aa, Artificial Sequence
  source: /note="Description of Artificial Sequence: Synthetic 6xHis tag"
HHHHHH

SEQ ID NO: 3359 - protein, 30 aa, Artificial Sequence
  source: /note="Description of Artificial Sequence: Synthetic polypeptide"
GGGGSGGGGSGGGGSGGGGSGGGGSGGGGS

SEQ ID NO: 3360 - protein, 8 aa, Artificial Sequence
  source: /note="Description of Artificial Sequence: Synthetic peptide"
  SITE (1)..(8): /note="This sequence may encompass 1-8 residues"
GGGGGGGG

SEQ ID NO: 3361 - protein, 5 aa, Artificial Sequence
  source: /note="Description of Artificial Sequence: Synthetic peptide"
GGGGS

SEQ ID NO: 3362 - protein, 8 aa, Artificial Sequence
  source: /note="Description of Artificial Sequence: Synthetic peptide"
  SITE (1)..(8): /note="This sequence may encompass 2-4 'Gly Ala' repeating units"
GAGAGAGA

SEQ ID NO: 3363 - protein, 8 aa, Artificial Sequence
  source: /note="Description of Artificial Sequence: Synthetic peptide"
  SITE (1)..(8): /note="This sequence may encompass 1-8 residues"
AAAAAAAA

SEQ ID NO: 3364 - protein, 5 aa, Homo sapiens
AWLVK

SEQ ID NO: 3365 - protein, 5 aa, Artificial Sequence
  source: /note="Description of Artificial Sequence: Synthetic peptide"
GGGGA

SEQ ID NO: 3366 - protein, 214 aa, Artificial Sequence
  source: /note="Description of Artificial Sequence: Synthetic polypeptide"
DIQMTQSPSSLSASIGDRVTITCRASQDLRNYLGWYHQKPGKAPKRLIYGASSLQSGVPSRFSGSGSGTCFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3367 - protein, 214 aa, Artificial Sequence; identical to SEQ ID NO: 342
  source: /note="Description of Artificial Sequence: Synthetic polypeptide"

SEQ ID NO: 3368 - protein, 214 aa, Artificial Sequence; identical to SEQ ID NO: 342
  source: /note="Description of Artificial Sequence: Synthetic polypeptide"

SEQ ID NO: 3369 - protein, 214 aa, Artificial Sequence
  source: /note="Description of Artificial Sequence: Synthetic polypeptide"
DIQLTQSPSSLSASVGDRVTITCRASQTISRFLNWYQQKPGKAPELLIYVASSLQSGVPSRFSGSGSGTCFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3370 - protein, 214 aa, Artificial Sequence
  source: /note="Description of Artificial Sequence: Synthetic polypeptide"
EIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3371 - protein, 214 aa, Artificial Sequence; identical to SEQ ID NO: 455
  source: /note="Description of Artificial Sequence: Synthetic polypeptide"

SEQ ID NO: 3372 - protein, 214 aa, Artificial Sequence; identical to SEQ ID NO: 455
  source: /note="Description of Artificial Sequence: Synthetic polypeptide"

SEQ ID NO: 3373 - protein, 214 aa, Artificial Sequence
  source: /note="Description of Artificial Sequence: Synthetic polypeptide"
EIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3374 - protein, 268 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLDIQMTQSPSSLSASIGDRVTITCRASQDIRDYLGWYQQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3375 - protein, 505 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3376 - protein, 268 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3377 - protein, 505 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3378 - protein, 268 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLDIQMTQSPSSLSASIGDRVTITCRASQDLRNYLGWYHQKPGKAPKRLIYGASSLQSGVPSRFSGSGSGTEFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3379 - protein, 505 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLQVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3380 - protein, 448 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNFNYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3381 - protein, 268 aa, Artificial Sequence
  source: /note="Description of Artificial Sequence: Synthetic polypeptide"
HGEGTFTSDLSKQMEEEAVRLAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3382 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3383 - protein, 259 aa, Artificial Sequence
  source: /note="Description of Artificial Sequence: Synthetic polypeptide"
HGEGTFTSDLSKQMEEEAVRLFGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3384 - protein, 260 aa, Artificial Sequence
  source: /note="Description of Artificial Sequence: Synthetic polypeptide"
HGEGTFTSDLSKQMEEEAVRLFIGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3385 - protein, 445 aa, Artificial Sequence
  source: /note="Description of Artificial Sequence: Synthetic polypeptide"
QVTLKESGPGILQPSQTLSLTCSFSGFSLSTFGMGVGWIRQPPGKGLEWLAHIWWDDDKYYNPALKSRLTISKDTSKNQVFLKIANVDTADTATYYCARKGNFAWFTYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3386 - protein, 214 aa, Artificial Sequence
  source: /note="Description of Artificial Sequence: Synthetic polypeptide"
DIQMTQSPSSLSASIGDRVTITCRASQDIRDYLGWYQQKPGKAPKRLIYGASSLQSGVPSRFSGSGSGTCFTLTISSLQPEDFATYYCLQHNNYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3387 - protein, 214 aa, Artificial Sequence; identical to SEQ ID NO: 316
  source: /note="Description of Artificial Sequence: Synthetic polypeptide"

SEQ ID NO: 3388 - protein, 214 aa, Artificial Sequence; identical to SEQ ID NO: 316
  source: /note="Description of Artificial Sequence: Synthetic polypeptide"

SEQ ID NO: 3389 - protein, 507 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLQVQLQESGPGLVKPSETLSLTCTVSGGSISSYYWSWIRQPPGKGLEWIGYIYYSGNTNSNPSLKSRVTISVDTSKNQFSLKLSSVTAADTAVYYCARTYYDSSGYYYRAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3390 - protein, 507 aa, Artificial Sequence
  source: /note="Description of Artificial Sequence: Synthetic polypeptide"
HGEGTFTSDVSSYLEEQAAKEFIAWLVKGGGGSGSATGGSGSVASSGSGSATHLQVQLQESGPGLVKPSETLSLTCTVSGGSISSYYWSWIRQPPGKGLEWIGYIYYSGNTNSNPSLKSRVTISVDTSKNQFSLKLSSVTAADTAVYYCARTYYDSSGYYYRAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3391 - protein, 506 aa, Artificial Sequence
  source: /note="Description of Artificial Sequence: Synthetic polypeptide"
HGEGTFTSDVSSYLEGQAAKEFIAWLVKGGGGSGSATGGSGSVASSGSGSATHLQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3392 - protein, 506 aa, Artificial Sequence
  source: /note="Description of Artificial Sequence: Synthetic polypeptide"
HGEGTFTSDVSSYLEEQAAKEFIAWLVKGGGGSGSATGGSGSVASSGSGSATHLQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3393 - protein, 505 aa, Artificial Sequence
  source: /note="Description of Artificial Sequence: Synthetic polypeptide"
HGEGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3394 - protein, 513 aa, Artificial Sequence
  source: /note="Description of Artificial Sequence: Synthetic polypeptide"
HGEGTFTSDLSKQMEEEAVRLFIEWLKNGGPSSGAPPPSGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3395 - protein, 513 aa, Artificial Sequence; identical to SEQ ID NO: 3394
  source: /note="Description of Artificial Sequence: Synthetic polypeptide"

SEQ ID NO: 3396 - protein, 486 aa, Artificial Sequence
  source: /note="Description of Artificial Sequence: Synthetic polypeptide"
HGEGTFTSDVSSYLEGQAAKEFIAWLVKGGGGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3397 - protein, 491 aa, Artificial Sequence
  source: /note="Description of Artificial Sequence: Synthetic polypeptide"
HGEGTFTSDVSSYLEGQAAKEFIAWLVKGGGGGGGSGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3398 - protein, 496 aa, Artificial Sequence
  source: /note="Description of Artificial Sequence: Synthetic polypeptide"
HGEGTFTSDVSSYLEGQAAKEFIAWLVKGGGGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3399 - protein, 501 aa, Artificial Sequence
  source: /note="Description of Artificial Sequence: Synthetic polypeptide"
HGEGTFTSDVSSYLEGQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3400 - protein, 492 aa, Artificial Sequence
  source: /note="Description of Artificial Sequence: Synthetic polypeptide"
HGEGTFTSDVSSYLEGQAAKEFIAWLVKGGGGAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3401 - protein, 496 aa, Artificial Sequence
  source: /note="Description of Artificial Sequence: Synthetic polypeptide"
HGEGTFTSDVSSYLEGQAAKEFIAWLVKGGGGAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3402 - protein, 500 aa, Artificial Sequence
  source: /note="Description of Artificial Sequence: Synthetic polypeptide"
HGEGTFTSDVSSYLEGQAAKEFIAWLVKGGGGAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3403 - protein, 504 aa, Artificial Sequence
  source: /note="Description of Artificial Sequence: Synthetic polypeptide"
HGEGTFTSDVSSYLEGQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3404 - protein, 505 aa, Artificial Sequence
  source: /note="Description of Artificial Sequence: Synthetic polypeptide"
HVEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3405 - protein, 505 aa, Artificial Sequence
  source: /note="Description of Artificial Sequence: Synthetic polypeptide"
HSEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3406 - protein, 505 aa, Artificial Sequence
  source: /note="Description of Artificial Sequence: Synthetic polypeptide"
HGQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3407 - protein, 505 aa, Artificial Sequence
  source: /note="Description of Artificial Sequence: Synthetic polypeptide"
HVQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3408 - protein, 505 aa, Artificial Sequence
  source: /note="Description of Artificial Sequence: Synthetic polypeptide"
HSQGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3409 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3410 - protein, 450 aa, Artificial Sequence; identical to SEQ ID NO: 3409
  source: /note="Description of Artificial Sequence: Synthetic polypeptide"

SEQ ID NO: 3411 - protein, 505 aa, Artificial Sequence
  source: /note="Description of Artificial Sequence: Synthetic polypeptide"
HVDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3412 - protein, 505 aa, Artificial Sequence
  source: /note="Description of Artificial Sequence: Synthetic polypeptide"
HGHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3413 - protein, 505 aa, Artificial Sequence; identical to SEQ ID NO: 3412
  source: /note="Description of Artificial Sequence: Synthetic polypeptide"

SEQ ID NO: 3414 - protein, 505 aa, Artificial Sequence
  source: /note="Description of Artificial Sequence: Synthetic polypeptide"
HVHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3415 - protein, 505 aa, Artificial Sequence
  source: /note="Description of Artificial Sequence: Synthetic polypeptide"
HSHGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3416 - protein, 505 aa, Artificial Sequence
  source: /note="Description of Artificial Sequence: Synthetic polypeptide"
HGDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3417 - protein, 505 aa, Artificial Sequence
  source: /note="Description of Artificial Sequence: Synthetic polypeptide"
HSDGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3418 - protein, 506 aa, Artificial Sequence
  source: /note="Description of Artificial Sequence: Synthetic polypeptide"
AHGEGTFTSDVSSYLEGQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3419 - protein, 455 aa, Artificial Sequence
  source: /note="Description of Artificial Sequence: Synthetic polypeptide"
QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 3420 - protein, 455 aa, Artificial Sequence
  source: /note="Description of Artificial Sequence: Synthetic polypeptide"
QVQLVESGGGVVQPGRSLRLSCAASGFTLSSYGMHWVRKAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 3421 - protein, 455 aa, Artificial Sequence
  source: /note="Description of Artificial Sequence: Synthetic polypeptide"
QVQLVESGGGVVQPGRSLRLSCAASGFTLSSYGMHWVRQAPGKKLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 3422 - protein, 455 aa, Artificial Sequence; identical to SEQ ID NO: 3419
  source: /note="Description of Artificial Sequence: Synthetic polypeptide"

SEQ ID NO: 3423 - protein, 455 aa, Artificial Sequence; identical to SEQ ID NO: 3420
  source: /note="Description of Artificial Sequence: Synthetic polypeptide"

SEQ ID NO: 3424 - protein, 455 aa, Artificial Sequence; identical to SEQ ID NO: 3421
  source: /note="Description of Artificial Sequence: Synthetic polypeptide"

SEQ ID NO: 3425 - protein, 455 aa, Artificial Sequence; identical to SEQ ID NO: 3419
  source: /note="Description of Artificial Sequence: Synthetic polypeptide"

SEQ ID NO: 3426 - protein, 455 aa, Artificial Sequence; identical to SEQ ID NO: 3420
  source: /note="Description of Artificial Sequence: Synthetic polypeptide"

SEQ ID NO: 3427 - protein, 455 aa, Artificial Sequence; identical to SEQ ID NO: 3421
  source: /note="Description of Artificial Sequence: Synthetic polypeptide"

SEQ ID NO: 3428 - protein, 455 aa, Artificial Sequence; identical to SEQ ID NO: 3419
  source: /note="Description of Artificial Sequence: Synthetic polypeptide"

SEQ ID NO: 3429 - protein, 455 aa, Artificial Sequence; identical to SEQ ID NO: 3420
  source: /note="Description of Artificial Sequence: Synthetic polypeptide"

SEQ ID NO: 3430 - protein, 455 aa, Artificial Sequence; identical to SEQ ID NO: 3421
  source: /note="Description of Artificial Sequence: Synthetic polypeptide"

SEQ ID NO: 3431 - protein, 455 aa, Artificial Sequence; identical to SEQ ID NO: 3419
  source: /note="Description of Artificial Sequence: Synthetic polypeptide"

SEQ ID NO: 3432 - protein, 455 aa, Artificial Sequence; identical to SEQ ID NO: 3420
  source: /note="Description of Artificial Sequence: Synthetic polypeptide"

SEQ ID NO: 3433 - protein, 455 aa, Artificial Sequence; identical to SEQ ID NO: 3421
  source: /note="Description of Artificial Sequence: Synthetic polypeptide"

SEQ ID NO: 3434 - protein, 455 aa, Artificial Sequence; identical to SEQ ID NO: 3419
  source: /note="Description of Artificial Sequence: Synthetic polypeptide"

SEQ ID NO: 3435 - protein, 455 aa, Artificial Sequence; identical to SEQ ID NO: 3420
  source: /note="Description of Artificial Sequence: Synthetic polypeptide"

SEQ ID NO: 3436 - protein, 455 aa, Artificial Sequence; identical to SEQ ID NO: 3421
  source: /note="Description of Artificial Sequence: Synthetic polypeptide"

SEQ ID NO: 3437 - protein, 108 aa, Artificial Sequence; identical to SEQ ID NO: 10
  source: /note="Description of Artificial Sequence: Synthetic polypeptide"

SEQ ID NO: 3438 - protein, 108 aa, Artificial Sequence; identical to SEQ ID NO: 10
  source: /note="Description of Artificial Sequence: Synthetic polypeptide"

SEQ ID NO: 3439 - protein, 108 aa, Artificial Sequence; identical to SEQ ID NO: 10
  source: /note="Description of Artificial Sequence: Synthetic polypeptide"

SEQ ID NO: 3440 - protein, 108 aa, Artificial Sequence; identical to SEQ ID NO: 10
  source: /note="Description of Artificial Sequence: Synthetic polypeptide"

SEQ ID NO: 3441 - protein, 108 aa, Artificial Sequence; identical to SEQ ID NO: 10
  source: /note="Description of Artificial Sequence: Synthetic polypeptide"

SEQ ID NO: 3442 - protein, 108 aa, Artificial Sequence; identical to SEQ ID NO: 10
  source: /note="Description of Artificial Sequence: Synthetic polypeptide"

SEQ ID NO: 3443 - protein, 108 aa, Artificial Sequence; identical to SEQ ID NO: 10
  source: /note="Description of Artificial Sequence: Synthetic polypeptide"

SEQ ID NO: 3444 - protein, 108 aa, Artificial Sequence; identical to SEQ ID NO: 10
  source: /note="Description of Artificial Sequence: Synthetic polypeptide"

SEQ ID NO: 3445 - protein, 108 aa, Artificial Sequence; identical to SEQ ID NO: 10
  source: /note="Description of Artificial Sequence: Synthetic polypeptide"

SEQ ID NO: 3446 - protein, 108 aa, Artificial Sequence; identical to SEQ ID NO: 10
  source: /note="Description of Artificial Sequence: Synthetic polypeptide"

SEQ ID NO: 3447 - protein, 108 aa, Artificial Sequence; identical to SEQ ID NO: 10
  source: /note="Description of Artificial Sequence: Synthetic polypeptide"

SEQ ID NO: 3448 - protein, 214 aa, Artificial Sequence
  source: /note="Description of Artificial Sequence: Synthetic polypeptide"
EIVMTQSPATLSVSPGERATLSCRASQSVSSNLAWYQKKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 3449 - protein, 214 aa, Artificial Sequence; identical to SEQ ID NO: 3448
  source: /note="Description of Artificial Sequence: Synthetic polypeptide"

SEQ ID NO: 3450 - protein, 214 aa, Artificial Sequence; identical to SEQ ID NO: 3448
  source: /note="Description of Artificial Sequence: Synthetic polypeptide"

SEQ ID NO: 3451 - protein, 214 aa, Artificial Sequence; identical to SEQ ID NO: 3448
  source: /note="Description of Artificial Sequence: Synthetic polypeptide"

SEQ ID NO: 3452 - protein, 214 aa, Artificial Sequence; identical to SEQ ID NO: 3448
  source: /note="Description of Artificial Sequence: Synthetic polypeptide"

SEQ ID NO: 3453 - protein, 214 aa, Artificial Sequence; identical to SEQ ID NO: 3448
  source: /note="Description of Artificial Sequence: Synthetic polypeptide"

SEQ ID NO: 3454 - protein, 214 aa, Artificial Sequence; identical to SEQ ID NO: 3448
  source: /note="Description of Artificial Sequence: Synthetic polypeptide"

SEQ ID NO: 3455 - protein, 214 aa, Artificial Sequence; identical to SEQ ID NO: 3448
  source: /note="Description of Artificial Sequence: Synthetic polypeptide"

SEQ ID NO: 3456 - protein, 214 aa, Artificial Sequence; identical to SEQ ID NO: 3448
  source: /note="Description of Artificial Sequence: Synthetic polypeptide"

SEQ ID NO: 3457 - protein, 214 aa, Artificial Sequence; identical to SEQ ID NO: 3448
  source: /note="Description of Artificial Sequence: Synthetic polypeptide"

SEQ ID NO: 3458 - protein, 214 aa, Artificial Sequence; identical to SEQ ID NO: 3448
  source: /note="Description of Artificial Sequence: Synthetic polypeptide"

SEQ ID NO: 3459 - protein, 214 aa, Artificial Sequence
  source: /note="Description of Artificial Sequence: Synthetic polypeptide"
EIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 3460 - protein, 214 aa, Artificial Sequence; identical to SEQ ID NO: 3459
  source: /note="Description of Artificial Sequence: Synthetic polypeptide"

SEQ ID NO: 3461 - protein, 214 aa, Artificial Sequence; identical to SEQ ID NO: 3459
  source: /note="Description of Artificial Sequence: Synthetic polypeptide"

SEQ ID NO: 3462 - protein, 214 aa, Artificial Sequence; identical to SEQ ID NO: 3459
  source: /note="Description of Artificial Sequence: Synthetic polypeptide"

SEQ ID NO: 3463 - protein, 214 aa, Artificial Sequence; identical to SEQ ID NO: 3459
  source: /note="Description of Artificial Sequence: Synthetic polypeptide"

SEQ ID NO: 3464 - protein, 214 aa, Artificial Sequence; identical to SEQ ID NO: 3459
  source: /note="Description of Artificial Sequence: Synthetic polypeptide"

SEQ ID NO: 3465 - protein, 214 aa, Artificial Sequence; identical to SEQ ID NO: 3459
  source: /note="Description of Artificial Sequence: Synthetic polypeptide"

SEQ ID NO: 3466 - protein, 214 aa, Artificial Sequence; identical to SEQ ID NO: 3459
  source: /note="Description of Artificial Sequence: Synthetic polypeptide"

SEQ ID NO: 3467 - protein, 214 aa, Artificial Sequence; identical to SEQ ID NO: 3459
  source: /note="Description of Artificial Sequence: Synthetic polypeptide"

SEQ ID NO: 3468 - protein, 214 aa, Artificial Sequence; identical to SEQ ID NO: 3459
  source: /note="Description of Artificial Sequence: Synthetic polypeptide"

SEQ ID NO: 3469 - protein, 214 aa, Artificial Sequence; identical to SEQ ID NO: 3459
  source: /note="Description of Artificial Sequence: Synthetic polypeptide"

SEQ ID NO: 3470 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3471 - protein, 505 aa, Artificial Sequence
  source: /note="Description of Artificial Sequence: Synthetic polypeptide"
HSEGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3472 - protein, 505 aa, Artificial Sequence
  source: /note="Description of Artificial Sequence: Synthetic polypeptide"
HSQGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3473 - protein, 505 aa, Artificial Sequence
  source: /note="Description of Artificial Sequence: Synthetic polypeptide"
HGDGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3474 - protein, 505 aa, Artificial Sequence
  source: /note="Description of Artificial Sequence: Synthetic polypeptide"
HSDGTFTSDVSSYLEEQAAKEFIAWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3475 - protein, 505 aa, Artificial Sequence
  source: /note="Description of Artificial Sequence: Synthetic polypeptide"
HGEGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3476 - protein, 505 aa, Artificial Sequence
  source: /note="Description of Artificial Sequence: Synthetic polypeptide"
HSEGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3477 - protein, 505 aa, Artificial Sequence
  source: /note="Description of Artificial Sequence: Synthetic polypeptide"
HSQGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3478 - protein, 505 aa, Artificial Sequence
  source: /note="Description of Artificial Sequence: Synthetic polypeptide"
HGDGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3479 - protein, 505 aa, Artificial Sequence
  source: /note="Description of Artificial Sequence: Synthetic polypeptide"
HSDGTFTSDVSSYLEEQAAKEFIEWLVKGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3480 - protein, 505 aa, Artificial Sequence
  source: /note="Description of Artificial Sequence: Synthetic polypeptide"
HGEGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3481 - protein, 505 aa, Artificial Sequence
  source: /note="Description of Artificial Sequence: Synthetic polypeptide"
HSEGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3482 - protein, 505 aa, Artificial Sequence
  source: /note="Description of Artificial Sequence: Synthetic polypeptide"
HSQGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3483 - protein, 505 aa, Artificial Sequence
  source: /note="Description of Artificial Sequence: Synthetic polypeptide"
HGDGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3484 - protein, 505 aa, Artificial Sequence
  source: /note="Description of Artificial Sequence: Synthetic polypeptide"
HSDGTFTSDVSSYLEEQAAKEFIAWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3485 - protein, 505 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3486 - protein, 505 aa, Artificial Sequence
  source: /note="Description of Artificial Sequence: Synthetic polypeptide"
HSEGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3487 - protein, 505 aa, Artificial Sequence; identical to SEQ ID NO: 3486
  source: /note="Description of Artificial Sequence: Synthetic polypeptide"

SEQ ID NO: 3488 - protein, 505 aa, Artificial Sequence
  source: /note="Description of Artificial Sequence: Synthetic polypeptide"
HSQGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3489 - protein, 505 aa, Artificial Sequence
  source: /note="Description of Artificial Sequence: Synthetic polypeptide"
HGDGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3490 - protein, 505 aa, Artificial Sequence
  source: /note="Description of Artificial Sequence: Synthetic polypeptide"
HSDGTFTSDVSSYLEEQAAKEFIEWLKNGGGGSGSATGGSGSVASSGSGSATHLQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3491 - protein, 501 aa, Artificial Sequence
  source: /note="Description of Artificial Sequence: Synthetic polypeptide"
HGEGTFTSDVSSYLEEQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3492 - protein, 501 aa, Artificial Sequence
  source: /note="Description of Artificial Sequence: Synthetic polypeptide"
HSEGTFTSDVSSYLEEQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3493 - protein, 501 aa, Artificial Sequence
  source: /note="Description of Artificial Sequence: Synthetic polypeptide"
HSQGTFTSDVSSYLEEQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3494 - protein, 501 aa, Artificial Sequence
  source: /note="Description of Artificial Sequence: Synthetic polypeptide"
HGDGTFTSDVSSYLEEQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3495 - protein, 501 aa, Artificial Sequence
  source: /note="Description of Artificial Sequence: Synthetic polypeptide"
HSDGTFTSDVSSYLEEQAAKEFIAWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3496 - protein, 501 aa, Artificial Sequence
  source: /note="Description of Artificial Sequence: Synthetic polypeptide"
HGEGTFTSDVSSYLEEQAAKEFIEWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3497 - protein, 501 aa, Artificial Sequence
  source: /note="Description of Artificial Sequence: Synthetic polypeptide"
HSEGTFTSDVSSYLEEQAAKEFIEWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3498 - protein, 501 aa, Artificial Sequence
  source: /note="Description of Artificial Sequence: Synthetic polypeptide"
HSQGTFTSDVSSYLEEQAAKEFIEWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3499 - protein, 501 aa, Artificial Sequence
  source: /note="Description of Artificial Sequence: Synthetic polypeptide"
HGDGTFTSDVSSYLEEQAAKEFIEWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3500 - protein, 501 aa, Artificial Sequence
  source: /note="Description of Artificial Sequence: Synthetic polypeptide"
HSDGTFTSDVSSYLEEQAAKEFIEWLVKGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3501 - protein, 501 aa, Artificial Sequence
  source: /note="Description of Artificial Sequence: Synthetic polypeptide"
HGEGTFTSDVSSYLEEQAAKEFIAWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3502 - protein, 501 aa, Artificial Sequence
  source: /note="Description of Artificial Sequence: Synthetic polypeptide"
HSEGTFTSDVSSYLEEQAAKEFIAWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3503 - protein, 501 aa, Artificial Sequence
  source: /note="Description of Artificial Sequence: Synthetic polypeptide"
HSQGTFTSDVSSYLEEQAAKEFIAWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3504 - protein, 501 aa, Artificial Sequence
  source: /note="Description of Artificial Sequence: Synthetic polypeptide"
HGDGTFTSDVSSYLEEQAAKEFIAWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3505 - protein, 501 aa, Artificial Sequence
  source: /note="Description of Artificial Sequence: Synthetic polypeptide"
HSDGTFTSDVSSYLEEQAAKEFIAWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3506 - protein, 501 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3507 - protein, 501 aa, Artificial Sequence
  source: /note="Description of Artificial Sequence: Synthetic polypeptide"
HSEGTFTSDVSSYLEEQAAKEFIEWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3508 - protein, 501 aa, Artificial Sequence; identical to SEQ ID NO: 3507
  source: /note="Description of Artificial Sequence: Synthetic polypeptide"

SEQ ID NO: 3509 - protein, 501 aa, Artificial Sequence
  source: /note="Description of Artificial Sequence: Synthetic polypeptide"
HSQGTFTSDVSSYLEEQAAKEFIEWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3510 - protein, 501 aa, Artificial Sequence
  source: /note="Description of Artificial Sequence: Synthetic polypeptide"
HGDGTFTSDVSSYLEEQAAKEFIEWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3511 - protein, 501 aa, Artificial Sequence
  source: /note="Description of Artificial Sequence: Synthetic polypeptide"
HSDGTFTSDVSSYLEEQAAKEFIEWLKNGGGGGGGAGGGGAGGGGAGGGGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3512 - protein, 504 aa, Artificial Sequence
  source: /note="Description of Artificial Sequence: Synthetic polypeptide"
HGEGTFTSDVSSYLEEQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3513 - protein, 504 aa, Artificial Sequence
  source: /note="Description of Artificial Sequence: Synthetic polypeptide"
HSEGTFTSDVSSYLEEQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3514 - protein, 504 aa, Artificial Sequence
  source: /note="Description of Artificial Sequence: Synthetic polypeptide"
HSQGTFTSDVSSYLEEQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3515 - protein, 504 aa, Artificial Sequence
  source: /note="Description of Artificial Sequence: Synthetic polypeptide"
HGDGTFTSDVSSYLEEQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3516 - protein, 504 aa, Artificial Sequence
  source: /note="Description of Artificial Sequence: Synthetic polypeptide"
HSDGTFTSDVSSYLEEQAAKEFIAWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3517 - protein, 504 aa, Artificial Sequence
  source: /note="Description of Artificial Sequence: Synthetic polypeptide"
HGEGTFTSDVSSYLEEQAAKEFIEWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3518 - protein, 504 aa, Artificial Sequence
  source: /note="Description of Artificial Sequence: Synthetic polypeptide"
HSEGTFTSDVSSYLEEQAAKEFIEWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3519 - protein, 504 aa, Artificial Sequence
  source: /note="Description of Artificial Sequence: Synthetic polypeptide"
HSQGTFTSDVSSYLEEQAAKEFIEWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3520 - protein, 504 aa, Artificial Sequence
  source: /note="Description of Artificial Sequence: Synthetic polypeptide"
HGDGTFTSDVSSYLEEQAAKEFIEWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3521 - protein, 504 aa, Artificial Sequence
  source: /note="Description of Artificial Sequence: Synthetic polypeptide"
HSDGTFTSDVSSYLEEQAAKEFIEWLVKGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3522 - protein, 504 aa, Artificial Sequence
  source: /note="Description of Artificial Sequence: Synthetic polypeptide"
HGEGTFTSDVSSYLEEQAAKEFIAWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3523 - protein, 504 aa, Artificial Sequence
  source: /note="Description of Artificial Sequence: Synthetic polypeptide"
HSEGTFTSDVSSYLEEQAAKEFIAWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3524 - protein, 504 aa, Artificial Sequence
  source: /note="Description of Artificial Sequence: Synthetic polypeptide"
HSQGTFTSDVSSYLEEQAAKEFIAWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3525 - protein, 504 aa, Artificial Sequence
  source: /note="Description of Artificial Sequence: Synthetic polypeptide"
HGDGTFTSDVSSYLEEQAAKEFIAWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3526 - protein, 504 aa, Artificial Sequence
  source: /note="Description of Artificial Sequence: Synthetic polypeptide"
HSDGTFTSDVSSYLEEQAAKEFIAWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3527 - protein, 504 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3528 - protein, 504 aa, Artificial Sequence
  source: /note="Description of Artificial Sequence: Synthetic polypeptide"
HSEGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3529 - protein, 504 aa, Artificial Sequence; identical to SEQ ID NO: 3528
  source: /note="Description of Artificial Sequence: Synthetic polypeptide"

SEQ ID NO: 3530 - protein, 504 aa, Artificial Sequence
  source: /note="Description of Artificial Sequence: Synthetic polypeptide"
HSQGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3531 - protein, 504 aa, Artificial Sequence
  source: /note="Description of Artificial Sequence: Synthetic polypeptide"
HGDGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3532 - protein, 504 aa, Artificial Sequence
  source: /note="Description of Artificial Sequence: Synthetic polypeptide"
HSDGTFTSDVSSYLEEQAAKEFIEWLKNGGGGAPAPAPAPAPAPAPAPAPAPGQVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3533 - protein, 504 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3534 - protein, 503 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3535 - protein, 500 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3536 - protein, 512 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3537 - protein, 511 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3538 - protein, 508 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3539 - protein, 268 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3540 - protein, 267 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3541 - protein, 264 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3542 - protein, 276 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3543 - protein, 275 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3544 - protein, 272 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3545 - protein, 512 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3546 - protein, 270 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3547 - protein, 511 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3548 - protein, 269 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3549 - protein, 508 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3550 - protein, 266 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3551 - protein, 520 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3552 - protein, 278 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3553 - protein, 519 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3554 - protein, 277 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3555 - protein, 516 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGQMQVVQSGAEVKKPGASVKVSCKASGYTFTGYYMHWVRQAPGQGLEWMGWINPNSGGTNYAQKFQGRVTMTRDTSISTAYMELSSLRSDDTAVYYCARGGDYVFGTYRPHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3556 - protein, 274 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGQSVLTQPPSASGTPGQRVTISCSGSSSNIGSNYVNWYQHLPGTAPKLLIYTNNQRPSGVPDRFSGSKSGTSASLAISGLQSEDEADYFCATFDSSLNAPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3557 - protein, 505 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3558 - protein, 268 aa, Artificial Sequence
  source: /note="Description of Artificial Sequence: Synthetic polypeptide"
HGEGTFTSDVSSYLEEQAAKEFIEWLKNGGGGSGSATGGSGSVASSGSGSATHLDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3559 - protein, 504 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3560 - protein, 267 aa, Artificial Sequence
  source: /note="Description of Artificial Sequence: Synthetic polypeptide"
HGEGTFTSDVSSYLEEQAAKEFIEWLKNGGGGAPAPAPAPAPAPAPAPAPAPGDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3561 - protein, 501 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3562 - protein, 264 aa, Artificial Sequence
  source: /note="Description of Artificial Sequence: Synthetic polypeptide"
HGEGTFTSDVSSYLEEQAAKEFIEWLKNGGGGGGGAGGGGAGGGGAGGGGDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3563 - protein, 513 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3564 - protein, 276 aa, Artificial Sequence
  source: /note="Description of Artificial Sequence: Synthetic polypeptide"
HGEGTFTSDVSSYLEGEAVRLFIEWLKNGGPSSGAPPPSGSGSATGGSGSVASSGSGSATHLDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3565 - protein, 512 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3566 - protein, 275 aa, Artificial Sequence
  source: /note="Description of Artificial Sequence: Synthetic polypeptide"
HGEGTFTSDVSSYLEGEAVRLFIEWLKNGGPSSGAPPPSGAPAPAPAPAPAPAPAPAPAPGDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3567 - protein, 509 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGQVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3568 - protein, 272 aa, Artificial Sequence
  source: /note="Description of Artificial Sequence: Synthetic polypeptide"
HGEGTFTSDVSSYLEGEAVRLFIEWLKNGGPSSGAPPPSGGGGAGGGGAGGGGAGGGGDIQLTQSPSSLSASVGDRVTITCRASQTISRFLNWYQQKPGKAPELLIYVASSLQSGVPSRFSGSGSGTDFTLTISSLQPEDFATYYCQQSYSTLISFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3569 - protein, 504 aa, Artificial Sequence
  source: /note="Description of Artificial Sequence: Synthetic polypeptide"
HGEGTFTSDVSSYLEEQAAKEFIEWLVKGGGGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3570 - protein, 268 aa, Artificial Sequence
  source: /note="Description of Artificial Sequence: Synthetic polypeptide"
HGEGTFTSDVSSYLEEQAAKEFIEWLVKGGGGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3571 - protein, 500 aa, Artificial Sequence
  source: /note="Description of Artificial Sequence: Synthetic polypeptide"
HGEGTFTSDVSSYLEEQAAKEFIEWLVKGGGGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3572 - protein, 264 aa, Artificial Sequence
  source: /note="Description of Artificial Sequence: Synthetic polypeptide"
HGEGTFTSDVSSYLEEQAAKEFIEWLVKGGGGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3573 - protein, 504 aa, Artificial Sequence
  source: /note="Description of Artificial Sequence: Synthetic polypeptide"
HGEGTFTSDYSSYLEEQAAKEFIEWLKNGGGGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3574 - protein, 268 aa, Artificial Sequence
  source: /note="Description of Artificial Sequence: Synthetic polypeptide"
HGEGTFTSDYSSYLEEQAAKEFIEWLKNGGGGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3575 - protein, 503 aa, Artificial Sequence
  source: /note="Description of Artificial Sequence: Synthetic polypeptide"
HGEGTFTSDYSSYLEEQAAKEFIEWLKNGGGGAPAPAPAPAPAPAPAPAPAPGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3576 - protein, 267 aa, Artificial Sequence
  source: /note="Description of Artificial Sequence: Synthetic polypeptide"
HGEGTFTSDYSSYLEEQAAKEFIEWLKNGGGGAPAPAPAPAPAPAPAPAPAPGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3577 - protein, 500 aa, Artificial Sequence
  source: /note="Description of Artificial Sequence: Synthetic polypeptide"
HGEGTFTSDYSSYLEEQAAKEFIEWLKNGGGGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3578 - protein, 264 aa, Artificial Sequence
  source: /note="Description of Artificial Sequence: Synthetic polypeptide"
HGEGTFTSDYSSYLEEQAAKEFIEWLKNGGGGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3579 - protein, 504 aa, Artificial Sequence
  source: /note="Description of Artificial Sequence: Synthetic polypeptide"
HGEGTFTSEVSSYLEGQAAKEFIEWLKNGGGGSGSATGGSGSVASSGSGSATHLQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3580 - protein, 268 aa, Artificial Sequence
  source: /note="Description of Artificial Sequence: Synthetic polypeptide"
HGEGTFTSEVSSYLEGQAAKEFIEWLKNGGGGSGSATGGSGSVASSGSGSATHLEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3581 - protein, 503 aa, Artificial Sequence
  source: /note="Description of Artificial Sequence: Synthetic polypeptide"
HGEGTFTSEVSSYLEGQAAKEFIEWLKNGGGGAPAPAPAPAPAPAPAPAPAPGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3582 - protein, 267 aa, Artificial Sequence
  source: /note="Description of Artificial Sequence: Synthetic polypeptide"
HGEGTFTSEVSSYLEGQAAKEFIEWLKNGGGGAPAPAPAPAPAPAPAPAPAPGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3583 - protein, 500 aa, Artificial Sequence
  source: /note="Description of Artificial Sequence: Synthetic polypeptide"
HGEGTFTSEVSSYLEGQAAKEFIEWLKNGGGGGGGAGGGGAGGGGAGGGGQVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3584 - protein, 264 aa, Artificial Sequence
  source: /note="Description of Artificial Sequence: Synthetic polypeptide"
HGEGTFTSEVSSYLEGQAAKEFIEWLKNGGGGGGGAGGGGAGGGGAGGGGEIVMTQSPATLSVSPGERATLSCRASQSVSSNLAWYQQKPGQAPRLLIYGAATRATGIPARVSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3585 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3586 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3587 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3588 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3589 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3590 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3591 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3592 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3593 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3594 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3595 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3596 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3597 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3598 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3599 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3600 - protein, 264 aa, Artificial Sequence
  source: /note="Description of Artificial Sequence: Synthetic polypeptide"
HSEGTFTSDVSSYLEEQAAKEFIEWLKNPGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3601 - protein, 264 aa, Artificial Sequence
  source: /note="Description of Artificial Sequence: Synthetic polypeptide"
HSEGTFTSDVSSYLEEQAAKEFIEWLKNPGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3602 - protein, 286 aa, Artificial Sequence
  source: /note="Description of Artificial Sequence: Synthetic polypeptide"
MDMRVPAQLLGLLLLWLRGARCHSEGTFTSDVSSYLEEQAAKEFIEWLKNPGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3603 - protein, 264 aa, Artificial Sequence
  source: /note="Description of Artificial Sequence: Synthetic polypeptide"
HSEGTFTSDVSSYLEEQAAKEFIEWLKNPGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3604 - protein, 286 aa, Artificial Sequence
  source: /note="Description of Artificial Sequence: Synthetic polypeptide"
MDMRVPAQLLGLLLLWLRGARCHSEGTFTSDVSSYLEEQAAKEFIEWLKNPGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3605 - protein, 264 aa, Artificial Sequence
  source: /note="Description of Artificial Sequence: Synthetic polypeptide"
HGEGTFTSDVSSYLEEQAAKEFIEWLKNQGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3606 - protein, 286 aa, Artificial Sequence
  source: /note="Description of Artificial Sequence: Synthetic polypeptide"
MDMRVPAQLLGLLLLWLRGARCHGEGTFTSDVSSYLEEQAAKEFIEWLKNQGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3607 - protein, 264 aa, Artificial Sequence
  source: /note="Description of Artificial Sequence: Synthetic polypeptide"
HGEGTFTSDVSSYLEEQAAKEFIEWLKNQGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3608 - protein, 264 aa, Artificial Sequence
  source: /note="Description of Artificial Sequence: Synthetic polypeptide"
HGEGTFTSDVSSYLEEQAAKEFIEWLKNQGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3609 - protein, 264 aa, Artificial Sequence
  source: /note="Description of Artificial Sequence: Synthetic polypeptide"
HGEGTFTSDVSSYLEEQAAKEFIEWLKNQGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3610 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3611 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3612 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3613 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3614 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3615 - protein, 264 aa, Artificial Sequence
  source: /note="Description of Artificial Sequence: Synthetic polypeptide"
HGEGTFTSDVSSYLEEQAAKEFIEWLKNTGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3616 - protein, 264 aa, Artificial Sequence
  source: /note="Description of Artificial Sequence: Synthetic polypeptide"
HGEGTFTSDVSSYLEEQAAKEFIEWLKNTGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3617 - protein, 264 aa, Artificial Sequence
  source: /note="Description of Artificial Sequence: Synthetic polypeptide"
HGEGTFTSDVSSYLEEQAAKEFIEWLKNTGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3618 - protein, 286 aa, Artificial Sequence
  source: /note="Description of Artificial Sequence: Synthetic polypeptide"
MDMRVPAQLLGLLLLWLRGARCHGEGTFTSDVSSYLEEQAAKEFIEWLKNTGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3619 - protein, 286 aa, Artificial Sequence
  source: /note="Description of Artificial Sequence: Synthetic polypeptide"
MDMRVPAQLLGLLLLWLRGARCHGEGTFTSDVSSYLEEQAAKEFIEWLKNTGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3620 - protein, 286 aa, Artificial Sequence
  source: /note="Description of Artificial Sequence: Synthetic polypeptide"
MDMRVPAQLLGLLLLWLRGARCHSEGTFTSDVSSYLEEQAAKEFIEWLKNTGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3621 - protein, 264 aa, Artificial Sequence
  source: /note="Description of Artificial Sequence: Synthetic polypeptide"
HSEGTFTSDVSSYLEEQAAKEFIEWLKNTGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3622 - protein, 264 aa, Artificial Sequence
  source: /note="Description of Artificial Sequence: Synthetic polypeptide"
HSEGTFTSDVSSYLEEQAAKEFIEWLKNTGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3623 - protein, 264 aa, Artificial Sequence
  source: /note="Description of Artificial Sequence: Synthetic polypeptide"
HSEGTFTSDVSSYLEEQAAKEFIEWLKNTGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3624 - protein, 264 aa, Artificial Sequence
  source: /note="Description of Artificial Sequence: Synthetic polypeptide"
HSEGTFTSDVSSYLEEQAAKEFIEWLKNTGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3625 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3626 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3627 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3628 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3629 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3630 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3631 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3632 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3633 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3634 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3635 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3636 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3637 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3638 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3639 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3640 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVMTQSPATLSVSPGERATLSCRASQSVSSNLAWYQQKPGQAPRLLIYGAATRATGIPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3641 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVMTQSPATLSVSPGERATLSCRASQSVDLHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3642 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVLTQSPATLSLSPGERATLSCRASQSVSSNLAWYQQKPGQAPRLLIYGAATRATGIPDRFSGSGSGTEFTLTISRLEPEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3643 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVLTQSPATLSLSPGERATLSCRASQSVLSHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3644 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVLTQSPATLSLSPGERATLSCRASQSVDLHLAWYQQKPGQAPRLLIYEAATRATGIPDRFSGSGSGTEFTLTISRLEPEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3645 - protein, 264 aa, Artificial Sequence
  source: /note="Description of Artificial Sequence: Synthetic polypeptide"
HGEGTFTSDVSSYLEEQAAKEFIEWLKNEGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3646 - protein, 264 aa, Artificial Sequence
  source: /note="Description of Artificial Sequence: Synthetic polypeptide"
HSEGTFTSDVSSYLEEQAAKEFIEWLKNEGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3647 - protein, 264 aa, Artificial Sequence
  source: /note="Description of Artificial Sequence: Synthetic polypeptide"
HGEGTFTSDVSSYLEEQAAKEFIEWLKNPGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3648 - protein, 264 aa, Artificial Sequence
  source: /note="Description of Artificial Sequence: Synthetic polypeptide"
HSEGTFTSDVSSYLEEQAAKEFIEWLKNPGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3649 - protein, 264 aa, Artificial Sequence
  source: /note="Description of Artificial Sequence: Synthetic polypeptide"
HGEGTFTSDVSSYLEEQAAKEFIEWLKNQGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3650 - protein, 264 aa, Artificial Sequence
  source: /note="Description of Artificial Sequence: Synthetic polypeptide"
HSEGTFTSDVSSYLEEQAAKEFIEWLKNQGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3651 - protein, 264 aa, Artificial Sequence
  source: /note="Description of Artificial Sequence: Synthetic polypeptide"
HGEGTFTSDVSSYLEEQAAKEFIEWLKNTGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3652 - protein, 264 aa, Artificial Sequence
  source: /note="Description of Artificial Sequence: Synthetic polypeptide"
HSEGTFTSDVSSYLEEQAAKEFIEWLKNTGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3653 - protein, 264 aa, Artificial Sequence
  source: /note="Description of Artificial Sequence: Synthetic polypeptide"
HGEGTFTSDVSSYLEEQAAKEFIEWLKNVGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3654 - protein, 264 aa, Artificial Sequence
  source: /note="Description of Artificial Sequence: Synthetic polypeptide"
HSEGTFTSDVSSYLEEQAAKEFIEWLKNVGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3655 - protein, 264 aa, Artificial Sequence
  source: /note="Description of Artificial Sequence: Synthetic polypeptide"
HGEGTFTSDVSSYLEEQAAKEFIEWLKQGGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3656 - protein, 264 aa, Artificial Sequence
  source: /note="Description of Artificial Sequence: Synthetic polypeptide"
HSEGTFTSDVSSYLEEQAAKEFIEWLKQGGGGGGGAGGGGAGGGGAGGGGEIVMTQSPATLSVSPGERATLSCRASQSVLSHLAWYQQKPGQAPRLLIYEAATRATGIPARFSGSGSGTEFTLTISSLQSEDFAVYYCQQYQNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3657 - protein, 451 aa, Artificial Sequence; identical to SEQ ID NO: 499
  source: /note="Description of Artificial Sequence: Synthetic polypeptide"

SEQ ID NO: 3658 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3659 - protein, 451 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMCKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3660 - protein, 451 aa, Artificial Sequence; identical to SEQ ID NO: 612
  source: /note="Description of Artificial Sequence: Synthetic polypeptide"

SEQ ID NO: 3661 - protein, 451 aa, Artificial Sequence
  source: /note="Description of Artificial Sequence: Synthetic polypeptide"
EVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3662 - protein, 451 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3663 - protein, 451 aa, Artificial Sequence
  source: /note="Description of Artificial Sequence: Synthetic polypeptide"
QVQLVESGGGVVQPGRSLRLSCTASGFTFSSYGIHWVRQAPGKGLEWVAVIWYDGSNKFHADSVKGRFTISRDNSKNTLYLQMNSLRAEDSAMYFCARGKVAGMPEAFEIWGQGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMCKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3664 - protein, 451 aa, Artificial Sequence
  source: /note="Description of Artificial Sequence: Synthetic polypeptide"
EVQLVESGGGVVQPGRSLRLSCAASGFTFSNFGMHWVRQAPGKGLEWVAVIWYDGSNENYADSVKGRFTISRDNSKNTLYLHMNSLRAADTAVYYCARDGTIFGVVLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3665 - protein, 451 aa, Artificial Sequence; identical to SEQ ID NO: 474
  source: /note="Description of Artificial Sequence: Synthetic polypeptide"

SEQ ID NO: 3666 - protein, 214 aa, Artificial Sequence; identical to SEQ ID NO: 316
  source: /note="Description of Artificial Sequence: Synthetic polypeptide"

SEQ ID NO: 3667 - protein, 451 aa, Artificial Sequence; identical to SEQ ID NO: 612
  source: /note="Description of Artificial Sequence: Synthetic polypeptide"

SEQ ID NO: 3668 - protein, 214 aa, Artificial Sequence; identical to SEQ ID NO: 455
  source: /note="Description of Artificial Sequence: Synthetic polypeptide"

SEQ ID NO: 3669 - protein, 451 aa, Artificial Sequence; identical to SEQ ID NO: 499
  source: /note="Description of Artificial Sequence: Synthetic polypeptide"

SEQ ID NO: 3670 - protein, 214 aa, Artificial Sequence; identical to SEQ ID NO: 342
  source: /note="Description of Artificial Sequence: Synthetic polypeptide"

SEQ ID NO: 3671 - protein, 214 aa, Artificial Sequence
  source: /note="Description of Artificial Sequence: Synthetic polypeptide"
DIQMTQSPSSVSASVGDRVTITCRASQGISRRLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3672 - protein, 451 aa, Artificial Sequence
  source: /note="Description of Artificial Sequence: Synthetic polypeptide"
QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARGGGSGSYRYYYYGLDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3673 - protein, 451 aa, Artificial Sequence; identical to SEQ ID NO: 3672
  source: /note="Description of Artificial Sequence: Synthetic polypeptide"

SEQ ID NO: 3674 - protein, 451 aa, Artificial Sequence; identical to SEQ ID NO: 3672
  source: /note="Description of Artificial Sequence: Synthetic polypeptide"

SEQ ID NO: 3675 - protein, 451 aa, Artificial Sequence; identical to SEQ ID NO: 3672
  source: /note="Description of Artificial Sequence: Synthetic polypeptide"

SEQ ID NO: 3676 - protein, 220 aa, Artificial Sequence
  source: /note="Description of Artificial Sequence: Synthetic polypeptide"
DIVMTQSPSSLAMSVGQKVTMSCKSSQSLLNSSNQKNYLAWYQQKPGQSPKLLIYFASTRESGVPDRFIGSGSGTDFTLTISSVQAEDLADYFCQQHYYTPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3677 - protein, 451 aa, Artificial Sequence; identical to SEQ ID NO: 474
  source: /note="Description of Artificial Sequence: Synthetic polypeptide"

SEQ ID NO: 3678 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMCKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3679 - protein, 451 aa, Artificial Sequence
  source: /note="Description of Artificial Sequence: Synthetic polypeptide"
QVQLVESGGGVVQPGRSLRLSCAASGFTFSYFGMHWVRQAPGKGLEWVAVIWYDGSNKYYADSVKGRFTISRDNSKNTLYLQMNSLRAEDTAVYYCARDGTIFGVLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3680 - protein, 214 aa, Artificial Sequence
  source: /note="Description of Artificial Sequence: Synthetic polypeptide"
DIQMTQSPSSLSASEGDRVTITCRASQGIRNDLGWYQQKPGKAPKRLIYAASSLQSGVPLRFSGSGSGTEFTLTISSLQPEDFATYYCLQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3681 - protein, 214 aa, Artificial Sequence; identical to SEQ ID NO: 3680
  source: /note="Description of Artificial Sequence: Synthetic polypeptide"

SEQ ID NO: 3682 - protein, 215 aa, Artificial Sequence
  source: /note="Description of Artificial Sequence: Synthetic polypeptide"
EIVLTQSPGTLSLSPGERATLSCRASQGISRSELAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3683 - protein, 215 aa, Artificial Sequence; identical to SEQ ID NO: 3682
  source: /note="Description of Artificial Sequence: Synthetic polypeptide"

SEQ ID NO: 3684 - protein, 214 aa, Artificial Sequence; identical to SEQ ID NO: 316
  source: /note="Description of Artificial Sequence: Synthetic polypeptide"

SEQ ID NO: 3685 - protein, 214 aa, Artificial Sequence; identical to SEQ ID NO: 316
  source: /note="Description of Artificial Sequence: Synthetic polypeptide"

SEQ ID NO: 3686 - protein, 214 aa, Artificial Sequence; identical to SEQ ID NO: 316
  source: /note="Description of Artificial Sequence: Synthetic polypeptide"

SEQ ID NO: 3687 - protein, 214 aa, Artificial Sequence; identical to SEQ ID NO: 316
  source: /note="Description of Artificial Sequence: Synthetic polypeptide"

SEQ ID NO: 3688 - protein, 214 aa, Artificial Sequence; identical to SEQ ID NO: 316
  source: /note="Description of Artificial Sequence: Synthetic polypeptide"

SEQ ID NO: 3689 - protein, 214 aa, Artificial Sequence; identical to SEQ ID NO: 316
  source: /note="Description of Artificial Sequence: Synthetic polypeptide"

SEQ ID NO: 3690 - protein, 214 aa, Artificial Sequence; identical to SEQ ID NO: 316
  source: /note="Description of Artificial Sequence: Synthetic polypeptide"

SEQ ID NO: 3691 - protein, 214 aa, Artificial Sequence; identical to SEQ ID NO: 316
  source: /note="Description of Artificial Sequence: Synthetic polypeptide"

SEQ ID NO: 3692 - protein, 214 aa, Artificial Sequence; identical to SEQ ID NO: 316
  source: /note="Description of Artificial Sequence: Synthetic polypeptide"

SEQ ID NO: 3693 - protein, 214 aa, Artificial Sequence; identical to SEQ ID NO: 316
  source: /note="Description of Artificial Sequence: Synthetic polypeptide"

SEQ ID NO: 3694 - protein, 214 aa, Artificial Sequence; identical to SEQ ID NO: 316
  source: /note="Description of Artificial Sequence: Synthetic polypeptide"

SEQ ID NO: 3695 - protein, 214 aa, Artificial Sequence; identical to SEQ ID NO: 316
  source: /note="Description of Artificial Sequence: Synthetic polypeptide"

SEQ ID NO: 3696 - protein, 214 aa, Artificial Sequence; identical to SEQ ID NO: 316
  source: /note="Description of Artificial Sequence: Synthetic polypeptide"

SEQ ID NO: 3697 - protein, 214 aa, Artificial Sequence; identical to SEQ ID NO: 316
  source: /note="Description of Artificial Sequence: Synthetic polypeptide"

SEQ ID NO: 3698 - protein, 214 aa, Artificial Sequence; identical to SEQ ID NO: 316
  source: /note="Description of Artificial Sequence: Synthetic polypeptide"

SEQ ID NO: 3699 - protein, 214 aa, Artificial Sequence; identical to SEQ ID NO: 316
  source: /note="Description of Artificial Sequence: Synthetic polypeptide"

SEQ ID NO: 3700 - protein, 214 aa, Artificial Sequence; identical to SEQ ID NO: 324
  source: /note="Description of Artificial Sequence: Synthetic polypeptide"

SEQ ID NO: 3701 - protein, 214 aa, Artificial Sequence; identical to SEQ ID NO: 324
  source: /note="Description of Artificial Sequence: Synthetic polypeptide"

SEQ ID NO: 3702 - protein, 214 aa, Artificial Sequence; identical to SEQ ID NO: 316
  source: /note="Description of Artificial Sequence: Synthetic polypeptide"

SEQ ID NO: 3703 - protein, 214 aa, Artificial Sequence; identical to SEQ ID NO: 316
  source: /note="Description of Artificial Sequence: Synthetic polypeptide"

SEQ ID NO: 3704 - protein, 214 aa, Artificial Sequence; identical to SEQ ID NO: 316
  source: /note="Description of Artificial Sequence: Synthetic polypeptide"

SEQ ID NO: 3705 - protein, 214 aa, Artificial Sequence; identical to SEQ ID NO: 316
  source: /note="Description of Artificial Sequence: Synthetic polypeptide"

SEQ ID NO: 3706 - protein, 214 aa, Artificial Sequence; identical to SEQ ID NO: 316
  source: /note="Description of Artificial Sequence: Synthetic polypeptide"

SEQ ID NO: 3707 - protein, 214 aa, Artificial Sequence; identical to SEQ ID NO: 316
  source: /note="Description of Artificial Sequence: Synthetic polypeptide"

SEQ ID NO: 3708 - protein, 214 aa, Artificial Sequence; identical to SEQ ID NO: 316
  source: /note="Description of Artificial Sequence: Synthetic polypeptide"

SEQ ID NO: 3709 - protein, 214 aa, Artificial Sequence; identical to SEQ ID NO: 316
  source: /note="Description of Artificial Sequence: Synthetic polypeptide"

SEQ ID NO: 3710 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3711 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQEKPGKAPKLLIYTASSLQSEVPSRFSGSGSGTDFTLTISSLQPEDFAIYCCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3712 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYCCQQAHRFPPTFGEGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3713 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYYCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3714 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQEKPGKAPKLLIYTASSLQSEVPSRFSGSGSGTDFTLTISSLQPEDFAIYYCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3715 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYYCQQAHRFPPTFGEGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3716 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYSCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3717 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQEKPGKAPKLLIYTASSLQSEVPSRFSGSGSGTDFTLTISSLQPEDFAIYSCQQAHRFPPTFGQGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3718 - protein, 269 aa, Artificial Sequence
  source: /note="Description of Artificial Sequence: Synthetic polypeptide"
HGEGTFTSDLSKQMEEEAVRLFAAQAAQQGGGGSGSATGGSGSVASSGSGSATGSAIQMTQSPSSVSASIGDRVTITCRASQNINNLLAWYQQKPGKAPKLLIYTASSLQSEVPSRFSGSGSGTDFTLTISSLQPEDFAIYSCQQAHRFPPTFGEGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 3719 - protein, 269 aa, Artificial Sequence; identical to SEQ ID NO: 3710
  source: /note="Description of Artificial Sequence: Synthetic polypeptide"

SEQ ID NO: 3720 - protein, 269 aa, Artificial Sequence; identical to SEQ ID NO: 3711
  source: /note="Description of Artificial Sequence: Synthetic polypeptide"

SEQ ID NO: 3721 - protein, 269 aa, Artificial Sequence; identical to SEQ ID NO: 3712
  source: /note="Description of Artificial Sequence: Synthetic polypeptide"

SEQ ID NO: 3722 - protein, 269 aa, Artificial Sequence; identical to SEQ ID NO: 3713
  source: /note="Description of Artificial Sequence: Synthetic polypeptide"

SEQ ID NO: 3723 - protein, 269 aa, Artificial Sequence; identical to SEQ ID NO: 3714
  source: /note="Description of Artificial Sequence: Synthetic polypeptide"

SEQ ID NO: 3724 - protein, 269 aa, Artificial Sequence; identical to SEQ ID NO: 3715
  source: /note="Description of Artificial Sequence: Synthetic polypeptide"

SEQ ID NO: 3725 - protein, 269 aa, Artificial Sequence; identical to SEQ ID NO: 3716
  source: /note="Description of Artificial Sequence: Synthetic polypeptide"

SEQ ID NO: 3726 - protein, 269 aa, Artificial Sequence; identical to SEQ ID NO: 3717
  source: /note="Description of Artificial Sequence: Synthetic polypeptide"

SEQ ID NO: 3727 - protein, 269 aa, Artificial Sequence; identical to SEQ ID NO: 3718
  source: /note="Description of Artificial Sequence: Synthetic polypeptide"

SEQ ID NO: 3728 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 3729 - protein, 450 aa, Artificial Sequence; identical to SEQ ID NO: 3728
  source: /note="Description of Artificial Sequence: Synthetic polypeptide"

SEQ ID NO: 3730 - protein, 450 aa, Artificial Sequence; identical to SEQ ID NO: 3728
  source: /note="Description of Artificial Sequence: Synthetic polypeptide"

SEQ ID NO: 3731 - protein, 450 aa, Artificial Sequence; identical to SEQ ID NO: 3728
  source: /note="Description of Artificial Sequence: Synthetic polypeptide"

SEQ ID NO: 3732 - protein, 450 aa, Artificial Sequence; identical to SEQ ID NO: 3728
  source: /note="Description of Artificial Sequence: Synthetic polypeptide"

SEQ ID NO: 3733 - protein, 450 aa, Artificial Sequence; identical to SEQ ID NO: 3728
  source: /note="Description of Artificial Sequence: Synthetic polypeptide"

SEQ ID NO: 3734 - protein, 450 aa, Artificial Sequence; identical to SEQ ID NO: 3728
  source: /note="Description of Artificial Sequence: Synthetic polypeptide"

SEQ ID NO: 3735 - protein, 450 aa, Artificial Sequence; identical to SEQ ID NO: 3728
  source: /note="Description of Artificial Sequence: Synthetic polypeptide"

SEQ ID NO: 3736 - protein, 450 aa, Artificial Sequence; identical to SEQ ID NO: 3728
  source: /note="Description of Artificial Sequence: Synthetic polypeptide"

SEQ ID NO: 3737 - protein, 450 aa, Artificial Sequence; identical to SEQ ID NO: 3728
  source: /note="Description of Artificial Sequence: Synthetic polypeptide"

SEQ ID NO: 3738 - protein, 450 aa, Artificial Sequence; identical to SEQ ID NO: 3728
  source: /note="Description of Artificial Sequence: Synthetic polypeptide"

SEQ ID NO: 3739 - protein, 450 aa, Artificial Sequence
  source: /note="Description of Artificial Sequence: Synthetic polypeptide"
QVQLVESGGGVVQPGRSLRLSCAASGFTFSNYGMHWVREAPGEGLEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 3740 - protein, 450 aa, Artificial Sequence; identical to SEQ ID NO: 3739
  source: /note="Description of Artificial Sequence: Synthetic polypeptide"

SEQ ID NO: 3741 - protein, 450 aa, Artificial Sequence; identical to SEQ ID NO: 3739
  source: /note="Description of Artificial Sequence: Synthetic polypeptide"

SEQ ID NO: 3742 - protein, 450 aa, Artificial Sequence; identical to SEQ ID NO: 3739
  source: /note="Description of Artificial Sequence: Synthetic polypeptide"

SEQ ID NO: 3743 - protein, 450 aa, Artificial Sequence; identical to SEQ ID NO: 3739
  source: /note="Description of Artificial Sequence: Synthetic polypeptide"

SEQ ID NO: 3744 - protein, 450 aa, Artificial Sequence; identical to SEQ ID NO: 3739
  source: /note="Description of Artificial Sequence: Synthetic polypeptide"

SEQ ID NO: 3745 - protein, 450 aa, Artificial Sequence; identical to SEQ ID NO: 3739
  source: /note="Description of Artificial Sequence: Synthetic polypeptide"

SEQ ID NO: 3746 - protein, 450 aa, Artificial Sequence; identical to SEQ ID NO: 3739
  source: /note="Description of Artificial Sequence: Synthetic polypeptide"

SEQ ID NO: 3747 - protein, 450 aa, Artificial Sequence; identical to SEQ ID NO: 3739
  source: /note="Description of Artificial Sequence: Synthetic polypeptide"

SEQ ID NO: 3748 - protein, 450 aa, Artificial Sequence; identical to SEQ ID NO: 3739
  source: /note="Description of Artificial Sequence: Synthetic polypeptide"

SEQ ID NO: 3749 - protein, 450 aa, Artificial Sequence; identical to SEQ ID NO: 3739
  source: /note="Description of Artificial Sequence: Synthetic polypeptide"

SEQ ID NO: 3750 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEELEWVAAIWFDASDKYYADAVKGRFTISRDNSKNTLYLQMNSLRAEDTAVYYCARDQAIFGVVPDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 3751 - protein, 450 aa, Artificial Sequence; identical to SEQ ID NO: 3750
  source: /note="Description of Artificial Sequence: Synthetic polypeptide"

SEQ ID NO: 3752 - protein, 450 aa, Artificial Sequence; identical to SEQ ID NO: 3750
  source: /note="Description of Artificial Sequence: Synthetic polypeptide"

SEQ ID NO: 3753 - protein, 450 aa, Artificial Sequence; identical to SEQ ID NO: 3750
  source: /note="Description of Artificial Sequence: Synthetic polypeptide"

SEQ ID NO: 3754 - protein, 450 aa, Artificial Sequence; identical to SEQ ID NO: 3750
  source: /note="Description of Artificial Sequence: Synthetic polypeptide"

SEQ ID NO: 3755 - protein, 450 aa, Artificial Sequence; identical to SEQ ID NO: 3750
  source: /note="Description of Artificial Sequence: Synthetic polypeptide"

SEQ ID NO: 3756 - protein, 450 aa, Artificial Sequence; identical to SEQ ID NO: 3750
  source: /note="Description of Artificial Sequence: Synthetic polypeptide"

SEQ ID NO: 3757 - protein, 450 aa, Artificial Sequence; identical to SEQ ID NO: 3750
  source: /note="Description of Artificial Sequence: Synthetic polypeptide"

SEQ ID NO: 3758 - protein, 450 aa, Artificial Sequence; identical to SEQ ID NO: 3750
  source: /note="Description of Artificial Sequence: Synthetic polypeptide"

SEQ ID NO: 3759 - protein, 450 aa, Artificial Sequence; identical to SEQ ID NO: 3750
  source: /note="Description of Artificial Sequence: Synthetic polypeptide"

SEQ ID NO: 3760 - protein, 450 aa, Artificial Sequence; identical to SEQ ID NO: 3750
  source: /note="Description of Artificial Sequence: Synthetic polypeptide"

SEQ ID NO: 3761 - protein, 214 aa, Artificial Sequence; identical to SEQ ID NO: 389
  source: /note="Description of Artificial Sequence: Synthetic polypeptide"

SEQ ID NO: 3762 - protein, 214 aa, Artificial Sequence; identical to SEQ ID NO: 316
  source: /note="Description of Artificial Sequence: Synthetic polypeptide"

SEQ ID NO: 3763 - protein, 214 aa, Artificial Sequence; identical to SEQ ID NO: 316
  source: /note="Description of Artificial Sequence: Synthetic polypeptide"

SEQ ID NO: 3764 - protein, 214 aa, Artificial Sequence; identical to SEQ ID NO: 316
  source: /note="Description of Artificial Sequence: Synthetic polypeptide"

SEQ ID NO: 3765 - protein, 214 aa, Artificial Sequence; identical to SEQ ID NO: 316
  source: /note="Description of Artificial Sequence: Synthetic polypeptide"

SEQ ID NO: 3766 - protein, 214 aa, Artificial Sequence; identical to SEQ ID NO: 316
  source: /note="Description of Artificial Sequence: Synthetic polypeptide"

SEQ ID NO: 3767 - protein, 214 aa, Artificial Sequence; identical to SEQ ID NO: 316
  source: /note="Description of Artificial Sequence: Synthetic polypeptide"

SEQ ID NO: 3768 - protein, 214 aa, Artificial Sequence; identical to SEQ ID NO: 316
  source: /note="Description of Artificial Sequence: Synthetic polypeptide"

SEQ ID NO: 3769 - protein, 214 aa, Artificial Sequence; identical to SEQ ID NO: 316
  source: /note="Description of Artificial Sequence: Synthetic polypeptide"

SEQ ID NO: 3770 - protein, 214 aa, Artificial Sequence; identical to SEQ ID NO: 316
  source: /note="Description of Artificial Sequence: Synthetic polypeptide"

SEQ ID NO: 3771 - protein, 214 aa, Artificial Sequence; identical to SEQ ID NO: 316
  source: /note="Description of Artificial Sequence: Synthetic polypeptide"

SEQ ID NO: 3772 - protein, 214 aa, Artificial Sequence; identical to SEQ ID NO: 316
  source: /note="Description of Artificial Sequence: Synthetic polypeptide"

SEQ ID NO: 3773 - protein, 214 aa, Artificial Sequence; identical to SEQ ID NO: 316
  source: /note="Description of Artificial Sequence: Synthetic polypeptide"

SEQ ID NO: 3774 - protein, 214 aa, Artificial Sequence; identical to SEQ ID NO: 316
  source: /note="Description of Artificial Sequence: Synthetic polypeptide"

SEQ ID NO: 3775 - protein, 214 aa, Artificial Sequence; identical to SEQ ID NO: 316
  source: /note="Description of Artificial Sequence: Synthetic polypeptide"

SEQ ID NO: 3776 - protein, 214 aa, Artificial Sequence; identical to SEQ ID NO: 316
  source: /note="Description of Artificial Sequence: Synthetic polypeptide"

SEQ ID NO: 3777 - protein, 214 aa, Artificial Sequence; identical to SEQ ID NO: 316
  source: /note="Description of Artificial Sequence: Synthetic polypeptide"

SEQ ID NO: 3778 - protein, 214 aa, Artificial Sequence; identical to SEQ ID NO: 316
  source: /note="Description of Artificial Sequence: Synthetic polypeptide"

SEQ ID NO: 3779 - protein, 214 aa, Artificial Sequence; identical to SEQ ID NO: 316
  source: /note="Description of Artificial Sequence: Synthetic polypeptide"

SEQ ID NO: 3780 - protein, 214 aa, Artificial Sequence; identical to SEQ ID NO: 316
  source: /note="Description of Artificial Sequence: Synthetic polypeptide"

SEQ ID NO: 3781 - protein, 214 aa, Artificial Sequence; identical to SEQ ID NO: 316
  source: /note="Description of Artificial Sequence: Synthetic polypeptide"

SEQ ID NO: 3782 - protein, 214 aa, Artificial Sequence; identical to SEQ ID NO: 316
  source: /note="Description of Artificial Sequence: Synthetic polypeptide"

SEQ ID NO: 3783 - protein, 214 aa, Artificial Sequence; identical to SEQ ID NO: 316
  source: /note="Description of Artificial Sequence: Synthetic polypeptide"

SEQ ID NO: 3784 - protein, 214 aa, Artificial Sequence; identical to SEQ ID NO: 316
  source: /note="Description of Artificial Sequence: Synthetic polypeptide"

SEQ ID NO: 3785 - protein, 214 aa, Artificial Sequence; identical to SEQ ID NO: 316
  source: /note="Description of Artificial Sequence: Synthetic polypeptide"

SEQ ID NO: 3786 - protein, 214 aa, Artificial Sequence; identical to SEQ ID NO: 316
  source: /note="Description of Artificial Sequence: Synthetic polypeptide"

SEQ ID NO: 3787 - protein, 214 aa, Artificial Sequence; identical to SEQ ID NO: 316
  source: /note="Description of Artificial Sequence: Synthetic polypeptide"

SEQ ID NO: 3788 - protein, 214 aa, Artificial Sequence; identical to SEQ ID NO: 316
  source: /note="Description of Artificial Sequence: Synthetic polypeptide"

SEQ ID NO: 3789 - protein, 214 aa, Artificial Sequence; identical to SEQ ID NO: 316
  source: /note="Description of Artificial Sequence: Synthetic polypeptide"

SEQ ID NO: 3790 - protein, 214 aa, Artificial Sequence; identical to SEQ ID NO: 316
  source: /note="Description of Artificial Sequence: Synthetic polypeptide"

SEQ ID NO: 3791 - protein, 214 aa, Artificial Sequence; identical to SEQ ID NO: 316
  source: /note="Description of Artificial Sequence: Synthetic polypeptide"

SEQ ID NO: 3792 - protein, 214 aa, Artificial Sequence; identical to SEQ ID NO: 316
  source: /note="Description of Artificial Sequence: Synthetic polypeptide"

SEQ ID NO: 3793 - protein, 214 aa, Artificial Sequence; identical to SEQ ID NO: 316
  source: /note="Description of Artificial Sequence: Synthetic polypeptide"

SEQ ID NO: 3794 - protein, 214 aa, Artificial Sequence; identical to SEQ ID NO: 316
  source: /note="Description of Artificial Sequence: Synthetic polypeptide"

SEQ ID NO: 3795 - protein, 214 aa, Artificial Sequence; identical to SEQ ID NO: 316
  source: /note="Description of Artificial Sequence: Synthetic polypeptide"

SEQ ID NO: 3796 - protein, 214 aa, Artificial Sequence; identical to SEQ ID NO: 316
  source: /note="Description of Artificial Sequence: Synthetic polypeptide"

SEQ ID NO: 3797 - protein, 214 aa, Artificial Sequence; identical to SEQ ID NO: 316
  source: /note="Description of Artificial Sequence: Synthetic polypeptide"

SEQ ID NO: 3798 - protein, 214 aa, Artificial Sequence; identical to SEQ ID NO: 316
  source: /note="Description of Artificial Sequence: Synthetic polypeptide"

SEQ ID NO: 3799 - protein, 214 aa, Artificial Sequence; identical to SEQ ID NO: 316
  source: /note="Description of Artificial Sequence: Synthetic polypeptide"

SEQ ID NO: 3800 - protein, 214 aa, Artificial Sequence; identical to SEQ ID NO: 316
  source: /note="Description of Artificial Sequence: Synthetic polypeptide"

SEQ ID NO: 3801 - protein, 214 aa, Artificial Sequence; identical to SEQ ID NO: 316
  source: /note="Description of Artificial Sequence: Synthetic polypeptide"

SEQ ID NO: 3802 - protein, 214 aa, Artificial Sequence; identical to SEQ ID NO: 316
  source: /note="Description of Artificial Sequence: Synthetic polypeptide"

SEQ ID NO: 3803 - protein, 214 aa, Artificial Sequence; identical to SEQ ID NO: 316
  source: /note="Description of Artificial Sequence: Synthetic polypeptide"

SEQ ID NO: 3804 - protein, 214 aa, Artificial Sequence; identical to SEQ ID NO: 316
  source: /note="Description of Artificial Sequence: Synthetic polypeptide"

SEQ ID NO: 3805 - protein, 214 aa, Artificial Sequence; identical to SEQ ID NO: 316
  source: /note="Description of Artificial Sequence: Synthetic polypeptide"

SEQ ID NO: 3806 - protein, 214 aa, Artificial Sequence; identical to SEQ ID NO: 316
  source: /note="Description of Artificial Sequence: Synthetic polypeptide"

SEQ ID NO: 3807 - protein, 214 aa, Artificial Sequence; identical to SEQ ID NO: 316
  source: /note="Description of Artificial Sequence: Synthetic polypeptide"

SEQ ID NO: 3808 - protein, 214 aa, Artificial Sequence; identical to SEQ ID NO: 316
  source: /note="Description of Artificial Sequence: Synthetic polypeptide"

SEQ ID NO: 3809 - protein, 214 aa, Artificial Sequence; identical to SEQ ID NO: 316
  source: /note="Description of Artificial Sequence: Synthetic polypeptide"

SEQ ID NO: 3810 - protein, 214 aa, Artificial Sequence; identical to SEQ ID NO: 316
  source: /note="Description of Artificial Sequence: Synthetic polypeptide"

SEQ ID NO: 3811 - protein, 214 aa, Artificial Sequence; identical to SEQ ID NO: 316
  source: /note="Description of Artificial Sequence: Synthetic polypeptide"

SEQ ID NO: 3812 - protein, 214 aa, Artificial Sequence; identical to SEQ ID NO: 316
  source: /note="Description of Artificial Sequence: Synthetic polypeptide"

SEQ ID NO: 3813 - protein, 214 aa, Artificial Sequence; identical to SEQ ID NO: 316
  source: /note="Description of Artificial Sequence: Synthetic polypeptide"

SEQ ID NO: 3814 - protein, 214 aa, Artificial Sequence; identical to SEQ ID NO: 316
  source: /note="Description of Artificial Sequence: Synthetic polypeptide"

SEQ ID NO: 3815 - protein, 214 aa, Artificial Sequence; identical to SEQ ID NO: 316
  source: /note="Description of Artificial Sequence: Synthetic polypeptide"

SEQ ID NO: 3816 - protein, 214 aa, Artificial Sequence; identical to SEQ ID NO: 316
  source: /note="Description of Artificial Sequence: Synthetic polypeptide"

SEQ ID NO: 3817 - protein, 214 aa, Artificial Sequence; identical to SEQ ID NO: 316
  source: /note="Description of Artificial Sequence: Synthetic polypeptide"

SEQ ID NO: 3818 - protein, 214 aa, Artificial Sequence; identical to SEQ ID NO: 316
  source: /note="Description of Artificial Sequence: Synthetic polypeptide"

SEQ ID NO: 3819 - protein, 214 aa, Artificial Sequence; identical to SEQ ID NO: 316
  source: /note="Description of Artificial Sequence: Synthetic polypeptide"

SEQ ID NO: 3820 - protein, 214 aa, Artificial Sequence; identical to SEQ ID NO: 316
  source: /note="Description of Artificial Sequence: Synthetic polypeptide"

SEQ ID NO: 3821 - protein, 214 aa, Artificial Sequence; identical to SEQ ID NO: 316
  source: /note="Description of Artificial Sequence: Synthetic polypeptide"

SEQ ID NO: 3822 - protein, 214 aa, Artificial Sequence; identical to SEQ ID NO: 316
  source: /note="Description of Artificial Sequence: Synthetic polypeptide"

SEQ ID NO: 3823 - protein, 214 aa, Artificial Sequence; identical to SEQ ID NO: 316
  source: /note="Description of Artificial Sequence: Synthetic polypeptide"

SEQ ID NO: 3824 - protein, 214 aa, Artificial Sequence; identical to SEQ ID NO: 324
  source: /note="Description of Artificial Sequence: Synthetic polypeptide"

SEQ ID NO: 3825 - protein, 214 aa, Artificial Sequence; identical to SEQ ID NO: 324
  source: /note="Description of Artificial Sequence: Synthetic polypeptide"

SEQ ID NO: 3826 - protein, 214 aa, Artificial Sequence; identical to SEQ ID NO: 324
  source: /note="Description of Artificial Sequence: Synthetic polypeptide"

SEQ ID NO: 3827 - protein, 214 aa, Artificial Sequence; identical to SEQ ID NO: 324
  source: /note="Description of Artificial Sequence: Synthetic polypeptide"

SEQ ID NO: 3828 - protein, 214 aa, Artificial Sequence; identical to SEQ ID NO: 324
  source: /note="Description of Artificial Sequence: Synthetic polypeptide"

SEQ ID NO: 3829 - protein, 214 aa, Artificial Sequence; identical to SEQ ID NO: 324
  source: /note="Description of Artificial Sequence: Synthetic polypeptide"

SEQ ID NO: 3830 - protein, 450 aa, Artificial Sequence; identical to SEQ ID NO: 542
  source: /note="Description of Artificial Sequence: Synthetic polypeptide"

SEQ ID NO: 3831 - protein, 450 aa, Artificial Sequence; identical to SEQ ID NO: 542
  source: /note="Description of Artificial Sequence: Synthetic polypeptide"

SEQ ID NO: 3832 - protein, 450 aa, Artificial Sequence; identical to SEQ ID NO: 542
  source: /note="Description of Artificial Sequence: Synthetic polypeptide"

SEQ ID NO: 3833 - protein, 450 aa, Artificial Sequence; identical to SEQ ID NO: 542
  source: /note="Description of Artificial Sequence: Synthetic polypeptide"

SEQ ID NO: 3834 - protein, 450 aa, Artificial Sequence; identical to SEQ ID NO: 542
  source: /note="Description of Artificial Sequence: Synthetic polypeptide"

SEQ ID NO: 3835 - protein, 450 aa, Artificial Sequence; identical to SEQ ID NO: 542
  source: /note="Description of Artificial Sequence: Synthetic polypeptide"

SEQ ID NO: 3836 - protein, 216 aa, Artificial Sequence; identical to SEQ ID NO: 449
  source: /note="Description of Artificial Sequence: Synthetic polypeptide"

SEQ ID NO: 3837 - protein, 458 aa, Artificial Sequence; identical to SEQ ID NO: 607
  source: /note="Description of Artificial Sequence: Synthetic polypeptide"

SEQ ID NO: 3838 - protein, 216 aa, Artificial Sequence; identical to SEQ ID NO: 449
  source: /note="Description of Artificial Sequence: Synthetic polypeptide"

SEQ ID NO: 3839 - protein, 458 aa, Artificial Sequence; identical to SEQ ID NO: 607
  source: /note="Description of Artificial Sequence: Synthetic polypeptide"

SEQ ID NO: 3840 - protein, 216 aa, Artificial Sequence; identical to SEQ ID NO: 449
  source: /note="Description of Artificial Sequence: Synthetic polypeptide"

SEQ ID NO: 3841 - protein, 458 aa, Artificial Sequence; identical to SEQ ID NO: 607
  source: /note="Description of Artificial Sequence: Synthetic polypeptide"

SEQ ID NO: 3842 - protein, 216 aa, Artificial Sequence; identical to SEQ ID NO: 449
  source: /note="Description of Artificial Sequence: Synthetic polypeptide"

SEQ ID NO: 3843 - protein, 458 aa, Artificial Sequence; identical to SEQ ID NO: 607
  source: /note="Description of Artificial Sequence: Synthetic polypeptide"

SEQ ID NO: 3844 - protein, 216 aa, Artificial Sequence; identical to SEQ ID NO: 449
  source: /note="Description of Artificial Sequence: Synthetic polypeptide"

SEQ ID NO: 3845 - protein, 458 aa, Artificial Sequence; identical to SEQ ID NO: 607
  source: /note="Description of Artificial Sequence: Synthetic polypeptide"

SEQ ID NO: 3846 - protein, 216 aa, Artificial Sequence; identical to SEQ ID NO: 449
  source: /note="Description of Artificial Sequence: Synthetic polypeptide"

SEQ ID NO: 3847 - protein, 458 aa, Artificial Sequence; identical to SEQ ID NO: 607
  source: /note="Description of Artificial Sequence: Synthetic polypeptide"

SEQ ID NO: 3848 - protein, 214 aa, Artificial Sequence; identical to SEQ ID NO: 455
  source: /note="Description of Artificial Sequence: Synthetic polypeptide"

SEQ ID NO: 3849 - protein, 451 aa, Artificial Sequence; identical to SEQ ID NO: 612
  source: /note="Description of Artificial Sequence: Synthetic polypeptide"

SEQ ID NO: 3850 - protein, 214 aa, Artificial Sequence; identical to SEQ ID NO: 455
  source: /note="Description of Artificial Sequence: Synthetic polypeptide"

SEQ ID NO: 3851 - protein, 451 aa, Artificial Sequence; identical to SEQ ID NO: 612
  source: /note="Description of Artificial Sequence: Synthetic polypeptide"

SEQ ID NO: 3852 - protein, 214 aa, Artificial Sequence; identical to SEQ ID NO: 455
  source: /note="Description of Artificial Sequence: Synthetic polypeptide"

SEQ ID NO: 3853 - protein, 451 aa, Artificial Sequence; identical to SEQ ID NO: 612
  source: /note="Description of Artificial Sequence: Synthetic polypeptide"

SEQ ID NO: 3854 - protein, 214 aa, Artificial Sequence; identical to SEQ ID NO: 455
  source: /note="Description of Artificial Sequence: Synthetic polypeptide"

SEQ ID NO: 3855 - protein, 451 aa, Artificial Sequence; identical to SEQ ID NO: 612
  source: /note="Description of Artificial Sequence: Synthetic polypeptide"

SEQ ID NO: 3856 - protein, 214 aa, Artificial Sequence; identical to SEQ ID NO: 455
  source: /note="Description of Artificial Sequence: Synthetic polypeptide"

SEQ ID NO: 3857 - protein, 451 aa, Artificial Sequence; identical to SEQ ID NO: 612
  source: /note="Description of Artificial Sequence: Synthetic polypeptide"

SEQ ID NO: 3858 - protein, 214 aa, Artificial Sequence; identical to SEQ ID NO: 455
  source: /note="Description of Artificial Sequence: Synthetic polypeptide"

SEQ ID NO: 3859 - protein, 451 aa, Artificial Sequence; identical to SEQ ID NO: 612
  source: /note="Description of Artificial Sequence: Synthetic polypeptide"

SEQ ID NO: 3860 - protein, 214 aa, Artificial Sequence; identical to SEQ ID NO: 324
  source: /note="Description of Artificial Sequence: Synthetic polypeptide"

SEQ ID NO: 3861 - protein, 450 aa, Artificial Sequence; identical to SEQ ID NO: 542
  source: /note="Description of Artificial Sequence: Synthetic polypeptide"

SEQ ID NO: 3862 - protein, 214 aa, Artificial Sequence; identical to SEQ ID NO: 324
  source: /note="Description of Artificial Sequence: Synthetic polypeptide"

SEQ ID NO: 3863 - protein, 450 aa, Artificial Sequence; identical to SEQ ID NO: 542
  source: /note="Description of Artificial Sequence: Synthetic polypeptide"

SEQ ID NO: 3864 - protein, 214 aa, Artificial Sequence; identical to SEQ ID NO: 324
  source: /note="Description of Artificial Sequence: Synthetic polypeptide"

SEQ ID NO: 3865 - protein, 450 aa, Artificial Sequence; identical to SEQ ID NO: 542
  source: /note="Description of Artificial Sequence: Synthetic polypeptide"

SEQ ID NO: 3866 - protein, 214 aa, Artificial Sequence; identical to SEQ ID NO: 324
  source: /note="Description of Artificial Sequence: Synthetic polypeptide"

SEQ ID NO: 3867 - protein, 450 aa, Artificial Sequence; identical to SEQ ID NO: 542
  source: /note="Description of Artificial Sequence: Synthetic polypeptide"

SEQ ID NO: 3868 - protein, 214 aa, Artificial Sequence; identical to SEQ ID NO: 324
  source: /note="Description of Artificial Sequence: Synthetic polypeptide"

SEQ ID NO: 3869 - protein, 450 aa, Artificial Sequence; identical to SEQ ID NO: 542
  source: /note="Description of Artificial Sequence: Synthetic polypeptide"

SEQ ID NO: 3870 - protein, 214 aa, Artificial Sequence; identical to SEQ ID NO: 324
  source: /note="Description of Artificial Sequence: Synthetic polypeptide"

SEQ ID NO: 3871 - protein, 450 aa, Artificial Sequence; identical to SEQ ID NO: 542
  source: /note="Description of Artificial Sequence: Synthetic polypeptide"

SEQ ID NO: 3872 - protein, 214 aa, Artificial Sequence; identical to SEQ ID NO: 324
  source: /note="Description of Artificial Sequence: Synthetic polypeptide"

SEQ ID NO: 3873 - protein, 450 aa, Artificial Sequence; identical to SEQ ID NO: 542
  source: /note="Description of Artificial Sequence: Synthetic polypeptide"

SEQ ID NO: 3874 - protein, 214 aa, Artificial Sequence; identical to SEQ ID NO: 324
  source: /note="Description of Artificial Sequence: Synthetic polypeptide"

SEQ ID NO: 3875 - protein, 450 aa, Artificial Sequence; identical to SEQ ID NO: 542
  source: /note="Description of Artificial Sequence: Synthetic polypeptide"

SEQ ID NO: 3876 - protein, 450 aa, Artificial Sequence; identical to SEQ ID NO: 542
  source: /note="Description of Artificial Sequence: Synthetic polypeptide"

SEQ ID NO: 3877 - protein, 450 aa, Artificial Sequence
  source: /note="Description of Artificial Sequence: Synthetic polypeptide"
QVQLVESGGGVVQPGRSLRLSCAASGFTFSNYGMHWVRQAPGEGLEWVAAIWFDASDKYYADAVKGRFTISRDNSKNTLYLQMNSLRAEDTAVYYCARDLAIFGVVPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3878 - protein, 450 aa, Artificial Sequence; identical to SEQ ID NO: 542
  source: /note="Description of Artificial Sequence: Synthetic polypeptide"

SEQ ID NO: 3879 - protein, 450 aa, Artificial Sequence; identical to SEQ ID NO: 3877
  source: /note="Description of Artificial Sequence: Synthetic polypeptide"

SEQ ID NO: 3880 - protein, 450 aa, Artificial Sequence; identical to SEQ ID NO: 3877
  source: /note="Description of Artificial Sequence: Synthetic polypeptide"

SEQ ID NO: 3881 - protein, 450 aa, Artificial Sequence; identical to SEQ ID NO: 542
  source: /note="Description of Artificial Sequence: Synthetic polypeptide"

SEQ ID NO: 3882 - protein, 450 aa, Artificial Sequence; identical to SEQ ID NO: 3877
  source: /note="Description of Artificial Sequence: Synthetic polypeptide"

SEQ ID NO: 3883 - protein, 450 aa, Artificial Sequence; identical to SEQ ID NO: 542
  source: /note="Description of Artificial Sequence: Synthetic polypeptide"

SEQ ID NO: 3884 - protein, 450 aa, Artificial Sequence; identical to SEQ ID NO: 3877
  source: /note="Description of Artificial Sequence: Synthetic polypeptide"

SEQ ID NO: 3885 - protein, 450 aa, Artificial Sequence; identical to SEQ ID NO: 3877
  source: /note="Description of Artificial Sequence: Synthetic polypeptide"

SEQ ID NO: 3886 - protein, 450 aa, Artificial Sequence; identical to SEQ ID NO: 542
  source: /note="Description of Artificial Sequence: Synthetic polypeptide"

SEQ ID NO: 3887 - protein, 450 aa, Artificial Sequence; identical to SEQ ID NO: 3877
  source: /note="Description of Artificial Sequence: Synthetic polypeptide"

SEQ ID NO: 3888 - protein, 450 aa, Artificial Sequence; identical to SEQ ID NO: 542
  source: /note="Description of Artificial Sequence: Synthetic polypeptide"

SEQ ID NO: 3889 - protein, 450 aa, Artificial Sequence; identical to SEQ ID NO: 3877
  source: /note="Description of Artificial Sequence: Synthetic polypeptide"

SEQ ID NO: 3890 - protein, 450 aa, Artificial Sequence; identical to SEQ ID NO: 3877
  source: /note="Description of Artificial Sequence: Synthetic polypeptide"

SEQ ID NO: 3891 - protein, 450 aa, Artificial Sequence; identical to SEQ ID NO: 542
  source: /note="Description of Artificial Sequence: Synthetic polypeptide"

SEQ ID NO: 3892 - protein, 450 aa, Artificial Sequence; identical to SEQ ID NO: 3877
  source: /note="Description of Artificial Sequence: Synthetic polypeptide"

SEQ ID NO: 3893 - protein, 450 aa, Artificial Sequence; identical to SEQ ID NO: 542
  source: /note="Description of Artificial Sequence: Synthetic polypeptide"

SEQ ID NO: 3894 - protein, 450 aa, Artificial Sequence; identical to SEQ ID NO: 3877
  source: /note="Description of Artificial Sequence: Synthetic polypeptide"

SEQ ID NO: 3895 - protein, 450 aa, Artificial Sequence; identical to SEQ ID NO: 3877
  source: /note="Description of Artificial Sequence: Synthetic polypeptide"

SEQ ID NO: 3896 - protein, 450 aa, Artificial Sequence; identical to SEQ ID NO: 542
  source: /note="Description of Artificial Sequence: Synthetic polypeptide"

SEQ ID NO: 3897 - protein, 450 aa, Artificial Sequence; identical to SEQ ID NO: 3877
  source: /note="Description of Artificial Sequence: Synthetic polypeptide"

SEQ ID NO: 3898 - protein, 450 aa, Artificial Sequence; identical to SEQ ID NO: 542
  source: /note="Description of Artificial Sequence: Synthetic polypeptide"

SEQ ID NO: 3899 - protein, 450 aa, Artificial Sequence; identical to SEQ ID NO: 3877
  source: /note="Description of Artificial Sequence: Synthetic polypeptide"

SEQ ID NO: 3900 - protein, 450 aa, Artificial Sequence; identical to SEQ ID NO: 3877
  source: /note="Description of Artificial Sequence: Synthetic polypeptide"

SEQ ID NO: 3901 - protein, 450 aa, Artificial Sequence; identical to SEQ ID NO: 542
  source: /note="Description of Artificial Sequence: Synthetic polypeptide"

SEQ ID NO: 3902 - protein, 450 aa, Artificial Sequence; identical to SEQ ID NO: 3877
  source: /note="Description of Artificial Sequence: Synthetic polypeptide"

SEQ ID NO: 3903 - protein, 450 aa, Artificial Sequence; identical to SEQ ID NO: 542
  source: /note="Description of Artificial Sequence: Synthetic polypeptide"

SEQ ID NO: 3904 - protein, 450 aa, Artificial Sequence; identical to SEQ ID NO: 3877
  source: /note="Description of Artificial Sequence: Synthetic polypeptide"

SEQ ID NO: 3905 - protein, 450 aa, Artificial Sequence; identical to SEQ ID NO: 3877
  source: /note="Description of Artificial Sequence: Synthetic polypeptide"

SEQ ID NO: 3906 - protein, 450 aa, Artificial Sequence; identical to SEQ ID NO: 542
  source: /note="Description of Artificial Sequence: Synthetic polypeptide"

SEQ ID NO: 3907 - protein, 450 aa, Artificial Sequence; identical to SEQ ID NO: 3877
  source: /note="Description of Artificial Sequence: Synthetic polypeptide"

SEQ ID NO: 3908 - protein, 450 aa, Artificial Sequence; identical to SEQ ID NO: 542
  source: /note="Description of Artificial Sequence: Synthetic polypeptide"

SEQ ID NO: 3909 - protein, 450 aa, Artificial Sequence; identical to SEQ ID NO: 3877
  source: /note="Description of Artificial Sequence: Synthetic polypeptide"

SEQ ID NO: 3910 - protein, 450 aa, Artificial Sequence; identical to SEQ ID NO: 3877
  source: /note="Description of Artificial Sequence: Synthetic polypeptide"

SEQ ID NO: 3911 - protein, 450 aa, Artificial Sequence; identical to SEQ ID NO: 542
  source: /note="Description of Artificial Sequence: Synthetic polypeptide"

SEQ ID NO: 3912 - protein, 450 aa, Artificial Sequence; identical to SEQ ID NO: 3877
  source: /note="Description of Artificial Sequence: Synthetic polypeptide"

SEQ ID NO: 3913 - protein, 450 aa, Artificial Sequence; identical to SEQ ID NO: 542
  source: /note="Description of Artificial Sequence: Synthetic polypeptide"

SEQ ID NO: 3914 - protein, 450 aa, Artificial Sequence; identical to SEQ ID NO: 3877
  source: /note="Description of Artificial Sequence: Synthetic polypeptide"

SEQ ID NO: 3915 - protein, 450 aa, Artificial Sequence; identical to SEQ ID NO: 3877
  source: /note="Description of Artificial Sequence: Synthetic polypeptide"

SEQ ID NO: 3916 - protein, 450 aa, Artificial Sequence; identical to SEQ ID NO: 542
  source: /note="Description of Artificial Sequence: Synthetic polypeptide"

SEQ ID NO: 3917 - protein, 450 aa, Artificial Sequence; identical to SEQ ID NO: 3877
  source: /note="Description of Artificial Sequence: Synthetic polypeptide"

SEQ ID NO: 3918 - protein, 450 aa, Artificial Sequence; identical to SEQ ID NO: 542
  source: /note="Description of Artificial Sequence: Synthetic polypeptide"

SEQ ID NO: 3919 - protein, 450 aa, Artificial Sequence; identical to SEQ ID NO: 3877
  source: /note="Description of Artificial Sequence: Synthetic polypeptide"

SEQ ID NO: 3920 - protein, 450 aa, Artificial Sequence; identical to SEQ ID NO: 3877
  source: /note="Description of Artificial Sequence: Synthetic polypeptide"

SEQ ID NO: 3921 - protein, 450 aa, Artificial Sequence; identical to SEQ ID NO: 542
  source: /note="Description of Artificial Sequence: Synthetic polypeptide"

SEQ ID NO: 3922 - protein, 450 aa, Artificial Sequence; identical to SEQ ID NO: 3877
  source: /note="Description of Artificial Sequence: Synthetic polypeptide"

SEQ ID NO: 3923 - protein, 450 aa, Artificial Sequence; identical to SEQ ID NO: 542
  source: /note="Description of Artificial Sequence: Synthetic polypeptide"

SEQ ID NO: 3924 - protein, 450 aa, Artificial Sequence; identical to SEQ ID NO: 3877
  source: /note="Description of Artificial Sequence: Synthetic polypeptide"

SEQ ID NO: 3925 - protein, 450 aa, Artificial Sequence; identical to SEQ ID NO: 3877
  source: /note="Description of Artificial Sequence: Synthetic polypeptide"

SEQ ID NO: 3926 - protein, 450 aa, Artificial Sequence; identical to SEQ ID NO: 542
  source: /note="Description of Artificial Sequence: Synthetic polypeptide"

SEQ ID NO: 3927 - protein, 450 aa, Artificial Sequence; identical to SEQ ID NO: 3877
  source: /note="Description of Artificial Sequence: Synthetic polypeptide"

SEQ ID NO: 3928 - protein, 450 aa, Artificial Sequence; identical to SEQ ID NO: 542
  source: /note="Description of Artificial Sequence: Synthetic polypeptide"

SEQ ID NO: 3929 - protein, 450 aa, Artificial Sequence; identical to SEQ ID NO: 3877
  source: /note="Description of Artificial Sequence: Synthetic polypeptide"

SEQ ID NO: 3930 - protein, 450 aa, Artificial Sequence; identical to SEQ ID NO: 3877
  source: /note="Description of Artificial Sequence: Synthetic polypeptide"

SEQ ID NO: 3931 - protein, 450 aa, Artificial Sequence; identical to SEQ ID NO: 542
  source: /note="Description of Artificial Sequence: Synthetic polypeptide"

SEQ ID NO: 3932 - protein, 450 aa, Artificial Sequence; identical to SEQ ID NO: 3877
  source: /note="Description of Artificial Sequence: Synthetic polypeptide"

SEQ ID NO: 3933 - protein, 450 aa, Artificial Sequence; identical to SEQ ID NO: 542
  source: /note="Description of Artificial Sequence: Synthetic polypeptide"

SEQ ID NO: 3934 - protein, 450 aa, Artificial Sequence; identical to SEQ ID NO: 3877
  source: /note="Description of Artificial Sequence: Synthetic polypeptide"

SEQ ID NO: 3935 - protein, 450 aa, Artificial Sequence; identical to SEQ ID NO: 3877
  source: /note="Description of Artificial Sequence: Synthetic polypeptide"

SEQ ID NO: 3936 - protein, 450 aa, Artificial Sequence; identical to SEQ ID NO: 3877
  source: /note="Description of Artificial Sequence: Synthetic polypeptide"

SEQ ID NO: 3937 - protein, 450 aa, Artificial Sequence; identical to SEQ ID NO: 3877
  source: /note="Description of Artificial Sequence: Synthetic polypeptide"

SEQ ID NO: 3938 - protein, 450 aa, Artificial Sequence; identical to SEQ ID NO: 3877
  source: /note="Description of Artificial Sequence: Synthetic polypeptide"

SEQ ID NO: 3939 - protein, 450 aa, Artificial Sequence; identical to SEQ ID NO: 3877
  source: /note="Description of Artificial Sequence: Synthetic polypeptide"

SEQ ID NO: 3940 - protein, 450 aa, Artificial Sequence; identical to SEQ ID NO: 3877
  source: /note="Description of Artificial Sequence: Synthetic polypeptide"

SEQ ID NO: 3941 - protein, 450 aa, Artificial Sequence; identical to SEQ ID NO: 3877
  source: /note="Description of Artificial Sequence: Synthetic polypeptide"

SEQ ID NO: 3942 - protein, 450 aa, Artificial Sequence; identical to SEQ ID NO: 3877
  source: /note="Description of Artificial Sequence: Synthetic polypeptide"

SEQ ID NO: 3943 - protein, 450 aa, Artificial Sequence; identical to SEQ ID NO: 3877
  source: /note="Description of Artificial Sequence: Synthetic polypeptide"

SEQ ID NO: 3944 - protein, 450 aa, Artificial Sequence; identical to SEQ ID NO: 3877
  source: /note="Description of Artificial Sequence: Synthetic polypeptide"

SEQ ID NO: 3945 - protein, 450 aa, Artificial Sequence; identical to SEQ ID NO: 3877
  source: /note="Description of Artificial Sequence: Synthetic polypeptide"

SEQ ID NO: 3946 - protein, 450 aa, Artificial Sequence; identical to SEQ ID NO: 3877
  source: /note="Description of Artificial Sequence: Synthetic polypeptide"

SEQ ID NO: 3947 - protein, 450 aa, Artificial Sequence; identical to SEQ ID NO: 3877
  source: /note="Description of Artificial Sequence: Synthetic polypeptide"

SEQ ID NO: 3948 - protein, 29 aa, Artificial Sequence
  source: /note="Description of Artificial Sequence: Synthetic peptide"
HAEGTFTSDVSSYLEGQAAKEFIAWLVKG

What is claimed is:

1. A glucagon like polypeptide-1 (GLP-1) receptor agonist, wherein said agonist comprises the amino acid sequence of SEQ ID NO: 3239.

2. A fusion protein comprising: the GLP-1 receptor agonist of claim 1.

3. The fusion protein of claim 2, wherein the GLP-1 receptor agonist is fused via a peptide bond at its C-terminus to an N-terminus of a human immunoglobulin light chain polypeptide.

4. The fusion protein of claim 3 further comprising: a peptide linker, wherein the peptide linker fuses the C-terminus of the GLP-1 receptor agonist to the N-terminus of the human immunoglobulin light chain polypeptide.

5. The fusion protein of claim 4, wherein the peptide linker comprises the amino acid sequence of SEQ ID NO: 3333.

6. The fusion protein of claim 3, wherein the human immunoglobulin light chain polypeptide comprises a complementarity determining region 1 (CDRL1) amino acid sequence of SEQ ID NO: 702, a CDRL2 amino acid sequence of SEQ ID NO: 859, and a CDRL3 amino acid sequence of SEQ ID NO:1016.

7. The fusion protein of claim 3, wherein the human immunoglobulin light chain polypeptide comprises a variable region (VL) comprising the amino acid sequence of SEQ ID NO: 74.

8. The fusion protein of claim 3, wherein the human immunoglobulin light chain polypeptide comprises the amino acid sequence of SEQ ID NO: 388.

9. The fusion protein of claim 2, wherein the GLP-1 receptor agonist is fused via a peptide bond at its C-terminus to an N-terminus of a human immunoglobulin heavy chain polypeptide.

10. The fusion protein of claim 9 further comprising: a peptide linker, wherein the peptide linker fuses the C-terminus of the GLP-1 receptor agonist to the N-terminus of the human immunoglobulin heavy chain polypeptide.

11. The fusion protein of claim 10, wherein the peptide linker comprises the amino acid sequence of SEQ ID NO: 3333.

12. The fusion protein of claim 9, wherein the human immunoglobulin heavy chain polypeptide comprises a complementarity determining region 1 (CDRH1) amino acid sequence of SEQ ID NO: 1173, a CDRH2 amino acid sequence of SEQ ID NO: 1330, and a CDRH3 amino acid sequence of SEQ ID NO: 1487.

13. The fusion protein of claim 9, wherein the human immunoglobulin heavy chain polypeptide comprises a variable region (VH) comprising the amino acid sequence of SEQ ID NO: 231.

14. The fusion protein of claim 9, wherein the human immunoglobulin heavy chain polypeptide comprises the amino acid sequence of SEQ ID NO: 545.

15. A fusion protein, said fusion protein comprising:

a GLP-1 receptor agonist comprising the amino acid sequence of SEQ ID NO: 3239;

an antibody comprising: (i) a human immunoglobulin light chain polypeptide comprising a CDRLI amino acid sequence of SEQ ID NO: 702, a CDRL2 amino acid sequence of SEQ ID NO: 859, and a CDRL3 amino acid sequence of SEQ ID NO: 1016, and (ii) a human immunoglobulin heavy chain polypeptide comprising a CDRH1 amino acid sequence of SEQ ID NO: 1173, a CDRH2 amino acid sequence of SEQ ID NO: 1330, and a CDRH3 amino acid sequence of SEQ ID NO: 1487; and a peptide linker comprising the amino acid sequence of SEQ ID NO: 3333, wherein the GLP-1 receptor agonist C-terminus is fused, via the peptide linker, to an N-terminus of the light chain polypeptide of the antibody.

16. The fusion protein of claim 15, wherein the human immunoglobulin light chain polypeptide comprises a variable region amino acid sequence of SEQ ID NO: 74, and the human immunoglobulin heavy chain polypeptide comprises a variable region amino acid sequence of SEQ ID NO: 231.

17. The fusion protein of claim 15, wherein the human immunoglobulin light chain polypeptide comprises an amino acid sequence of SEQ ID NO: 388 and the human immunoglobulin heavy chain polypeptide comprises an amino acid sequence of SEQ ID NO: 545.

18. A fusion protein, said fusion protein comprising:

a GLP-1 receptor agonist comprising the amino acid sequence of SEQ ID NO: 3239;

an antibody comprising: (i) a human immunoglobulin light chain polypeptide comprising a CDRL1 amino acid sequence of SEQ ID NO: 702, a CDRL2 amino acid sequence of SEQ ID NO: 859, and a CDRL3 amino acid sequence of SEQ ID NO: 1016, and (ii) a human immunoglobulin heavy chain polypeptide comprising a CDRHI amino acid sequence of SEQ ID NO: 1173, a CDRH2 amino acid sequence of SEQ ID NO: 1330, and a CDRH3 amino acid sequence of SEQ ID NO: 1487; and a peptide linker comprising the amino acid sequence of SEQ ID NO: 3333, wherein the GLP-1 receptor agonist C-terminus is fused, via the peptide linker, to an N-terminus of the heavy chain polypeptide of the antibody.

19. The fusion protein of claim 18, wherein the human immunoglobulin light chain polypeptide comprises a variable region amino acid sequence of SEQ ID NO: 74, and the human immunoglobulin heavy chain polypeptide comprises a variable region amino acid sequence of SEQ ID NO: 231.

20. The fusion protein of claim 18, wherein the human immunoglobulin light chain polypeptide comprises an amino acid sequence of SEQ ID NO: 388 and the human immunoglobulin heavy chain polypeptide comprises an amino acid sequence of SEQ ID NO: 545.

* * * * *